US008008004B2

(12) United States Patent
Phillips

(10) Patent No.: US 8,008,004 B2

(45) Date of Patent: Aug. 30, 2011

(54) COMPOSITIONS AND METHODS FOR THE DIAGNOSIS AND TREATMENT OF TUMORS OF GLIAL ORIGIN

(75) Inventor: Heidi S. Phillips, Palo Alto, CA (US)

(73) Assignee: Genentech Inc., South San Francisco, CA (US)

(*) Notice: Subject to any disclaimer, the term of this patent is extended or adjusted under 35 U.S.C. 154(b) by 188 days.

(21) Appl. No.: 11/625,272

(22) Filed: Jan. 19, 2007

(65) Prior Publication Data

US 2007/0231323 A1 Oct. 4, 2007

Related U.S. Application Data

(63) Continuation of application No. 10/852,335, filed on May 24, 2004, now abandoned.

(60) Provisional application No. 60/548,299, filed on Feb. 27, 2004, provisional application No. 60/473,238, filed on May 23, 2003.

(51) Int. Cl.

| | |
|---|---|
| ***C12Q 1/68*** | (2006.01) |
| ***G01N 33/574*** | (2006.01) |
| ***G01N 33/55*** | (2006.01) |

(52) U.S. Cl. .............................. 435/6; 435/7.1; 435/7.23

(58) Field of Classification Search ....................... 435/6

See application file for complete search history.

(56) References Cited

U.S. PATENT DOCUMENTS

| | | | |
|---|---|---|---|
| 6,416,758 | B1 | 7/2002 | Thorpe et al. |
| 6,428,788 | B1 | 8/2002 | Debinski et al. |
| 6,518,061 | B1 | 2/2003 | Puri et al. |
| 2003/0082586 | A1 | 5/2003 | Kirst et al. |

FOREIGN PATENT DOCUMENTS

| | | |
|---|---|---|
| JP | 2000-511042 | 8/2000 |
| WO | 96/29417 | 9/1996 |
| WO | 00/35935 | 6/2000 |
| WO | WO 01/36685 A2 | 5/2001 |
| WO | 03/024392 | 3/2003 |

OTHER PUBLICATIONS

Valasek and Repa (Adv. Physiolo. Educ. 2005; 29: 151-159).*

Bustin and Nolan (Journal of Biomolecular Techiques 2004; 15: 155-166).*

Bustin (Journal of Molecular Endocrinology 2002; 29: 23-29).*

Li at al., "Targeting glioblastoma multiforme with an IL-13/diphtheria toxin fusion protein in vitro and in vivo in nude mice" *Protein Engineering* 15:419-427 (2002).

M. Dorvillius, et al., "Targeting of human breast cancer by a bispecific antibody directed against two tumor-associated antigens: ErbB-2 and carcinoembryonic antigen" *Tumor Biology*23:337-347 (2002).

R. W. Weller, "Chemotherapy and Immunotherapy of malignant glioma: molecular mechanisms and clinical perspectives" *Cell Mol Life Sci*. 56:481-506 (Oct. 30, 1999).

Roth et al., "(abstact only)" *Cell Mol. Life Sci*. 56(5-6):481-506 (1999).

S. Gunia, et al., "CD44s-targeted treatment with monoclonal antibody blocks intracerebral invasion and growth at 9L gliosarcoma" *Clinical & Experimental Metastasis* 17:221-230 (1999).

S. M. Kipriyanov, et al., "Generation of Recombinant Antibodies" *Molecular Biotechnology* 12:173-201 (1999).

Samoylova et al., "Molecular Markers of Glial Tumors: Current Targeting Strategies" *Current Medicinal Chemistry* 10:831-843 (2003).

Raggi, C.C. et al., "Quantitative evaluation of somatostatin receptor subtype 2 expression in sporadic colorectal tumor and in the corresponding normal mucosa" *Clin. Cancer Res*. 8:419-427 (Feb. 2002).

Rich J N et al, "Gene Expression profiling and genetic markers in glioblastoma survival" *Cancer Research, American Association for Cancer Research*, Baltimore, MD, US 65(10):4051-4058 (May 15, 2005).

Salonga, D.S. et al., "Relative gene expression in normal and tumor tissue by quantitative RT-PCR" *Meth. Mol. Biol*. 191:83-98 (Mar. 1, 2002).

Zhou Yi-Hong et al., "Modeling prognosis for patients with malignant astrocytic gliomas: quantifying the expression of multiple genetic markers and clinical variables" *Neuro-Oncology* 7(4):485-494 (Oct. 2005).

Sahasrabudhe et al., "Enzymatic Biological Chemistry 268(22):16699-16705 generation of the amino terminus of the beta-amyloid peptide" (Aug. 5, 1993) *Journal of biological Chemistry*268(22): 16699-16705 (Aug. 5, 1993).

* cited by examiner

*Primary Examiner* — Laura B Goddard

(74) *Attorney, Agent, or Firm* — Carol A. Fang

(57) ABSTRACT

The present invention is directed to compositions of matter useful for the diagnosis and treatment of tumors of glial origin in mammals and to methods of using those compositions of matter for the same.

10 Claims, 228 Drawing Sheets

FIGURE 1

TGTGGCACTGCCTGCGTACCCAACCCCAGCCCTGGGTAGCCTGCAGCATGGCCCAGCTGTTCCTGCCCCTGCTGGCA
GCCCTGGTCCTGGCCCAGGCTCCTGCAGCTTTAGCAGATGTTCTGGAAGGAGACAGCTCAGAGGACCGCGCTTTTCG
CGTGCGCATCGCGGGCGACGCGCCACTGCAGGGCGTGCTCGGCGGCGCCCTCACCATCCCTTGCCACGTCCACTACC
TGCGGCCACCGCCGAGCCGCCGGGCTGTGCTGGGCTCTCCGCGGGTCAAGTGGACTTTCCTGTCCCGGGGCCGGGAG
GCAGAGGTGCTGGTGGCGCGGGGAGTGCGCGTCAAGGTGAACGAGGCCTACCGGTTCCGCGTGGCACTGCCTGCGTA
CCCAGCGTCGCTCACCGACGTCTCCCTGGCGCTGAGCGAGCTGCGCCCCAACGACTCAGGTATCTATCGCTGTGAGG
TCCAGCACGGCATCGATGACAGCAGCGACGCTGTGGAGGTCAAGGTCAAAGGGGTCGTCTTTCTCTACCGAGAGGGC
TCTGCCCGCTATGCTTTCTCCTTTTCTGGGGCCCAGGAGGCCTGTGCCCGCATTGGAGCCCACATCGCCACCCCGGA
GCAGCTCTATGCCGCCTACCTTGGGGGCTATGAGCAATGTGATGCTGGCTGGCTGTCGGATCAGACCGTGAGGTATC
CCATCCAGACCCCACGAGAGGCCTGTTACGGAGACATGGATGGCTTCCCCGGGGTCCGGAACTATGGTGTGGTGGAC
CCGGATGACCTCTATGATGTGTACTGTTATGCTGAAGACCTAAATGGAGAATTGTTCCTGGGTGACCCTCCAGAGAA
GCTGACATTGGAGGAAGCACGGGCGTACTGCCAGGAGCGGGGTGCAGAGATTGCCACCACGGGCCAACTGTATGCAG
CCTGGGATGGTGGCCTGGACCACTGCAGCCCAGGGTGGCTAGCTGATGGCAGTGTGCGCTACCCCATCGTCACACCC
AGCCAGCGCTGTGGTGGGGGCTTGCCTGGTGTCAAGACTCTCTTCCTCTTCCCCAACCAGACTGGCTTCCCCAATAA
GCACAGCCGCTTCAACGTCTACTGCTTCCGAGACTCGGCCCAGCCTTCTGCCATCCCTGAGGCCTCCAACCCAGCCT
CCAACCCAGCCTCTGATGGACTAGAGGCTATCGTCACAGTGACAGAGACCCTGGAGGAACTGCAGCTGCCTCAGGAA
GCCACAGAGAGTGAATCCCGTGGGGCCATCTACTCCATCCCCATCATGGAGGACGGAGGAGGTGGAAGCTCCACTCC
AGAAGACCCAGCAGAGGCCCCTAGGACGCTCCTAGAATTTGAAACACAATCCATGGTACCGCCCACGGGGTTCTCAG
AAGAGGAAGGTAAGGCATTGGAGGAAGAAGAGAAATATGAAGATGAAGAAGAGAAAGAGGAGGAAGAAGAAGAGGAG
GAGGTGGAGGATGAGGCTCTGTGGGCATGGCCCAGCGAGCTCAGCAGCCCGGGCCCTGAGGCCTCTCTCCCCACTGA
GCCAGCAGCCCAGGAGGAGTCACTCTCCCAGGCGCCAGCAAGGGCAGTCCTGCAGCCTGGTGCATCACCACTTCCTG
ATGGAGAGTCAGAAGCTTCCAGGCCTCCAAGGGTCCATGGACCACCTACTGAGACTCTGCCCACTCCCAGGGAGAGG
AACCTAGCATCCCCATCACCTTCCACTCTGGTTGAGGCAAGAGAGGTGGGGGAGGCAACTGGTGGTCCTGAGCTATC
TGGGGTCCCTCGAGGAGAGAGCGAGGAGACAGGAAGCTCCGAGGGTGCCCCTTCCCTGCTTCCAGCCACACGGGCCC
CTGAGGGTACCAGGGAGCTGGAGGCCCCCTCTGAAGATAATTCTGGAAGAACTGCCCCAGCAGGGACCTCAGTGCAG
GCCCAGCCAGTGCTGCCCACTGACAGCGCCAGCCGAGGTGGAGTGGCCGTGGTCCCCGCATCAGGTAATTCTGCCCA
AGGCTCAACTGCCCTCTCTATCCTACTCCTTTTCTTCCCCCTGCAGCTCTGGGTCACCTGACCTGTAGTCCTTTAAC
CCACCATCATCCCAAACTCTCCTGTCCTTTGCCTTCATTCTCTTACCCACCTCTACCTATGGGTCTCCAATCTCGGA
TATCCACCTTGTGGGTATCTCAGCTCTCCGCGTCTTTACCCTGTGATCCCAGCCCCGCCACTGACCATCTGTGACCC
TTCCCTGCCATTGGGCCCTCCACCTGTGGCTCACATCTCGCCAGCCCCACAGAGCATCCTCAGGCCTCTCCAAGGGT
CCTCATCACCTATTGCAGCCTTCAGGGCTCGGCCTATTTTCCACTACTCCCTTCATCCGCCTGTGTGCCGTCCCCTT
TAGCTGCCTCCTATTGATCTCAGGGAAGCCTGGGAGTCCCTTCTCACCCCTCAACCTCCGGAGTCCAGGAGAACCCG
TACCCCCACAGAGCCTTAAGCAACTACTTCTGTGAAGTATTTTTTGACTGTTTCATGGAAAACAAGCCTTGGAAATA
AATCTCTATTAAACCGC

FIGURE 2

GGGAGGCTGTGCCAGGCGAGCCGGAGGGGTGCTCCGCGCTCCCCCGCCCTCCTTCCGGGAGCGAGGATGCAGACTCT
GAAACTGGTGCTGCTGGGCTGAGGCGGAGGCAGGGGAGTTGCAGCGCGCGAGGCTCCGTGAGTGTGTCTCCTGCGCG
CTGAGAGGCGGGGGGAGGCGGAGGACCAGGAGGAGGAGGAGGAGGAGGAGGAGGGGGAGAATGCCCGGAGCCGCCGC
CGCTGCCGCCGCCGCCGCCGCCGCGATGCTCCCGGCTCAGGAGGCTGCCAAGCTGTACCACACCAACTATGTGCGGA
ACTCGCGGGCCATCGGCGTGCTGTGGGCCATCTTCACCATCTGCTTTGCCATCGTCAACGTGGTGTGCTTCATCCAG
CCCTACTGGATAGGCGACGGCGTGGACACCCCGCAAGCCGGCTATTTCGGGCTCTTCCACTACTGCATCGGCAACGG
CTTCTCCCGGGAGCTGACCTGCAGGGGCAGCTTCACGGACTTCTCCACGCTGCCCTCGGGCGCCTTCAAAGCCGCCT
CCTTCTTTATCGGCCTCTCCATGATGCTCATCATTGCCTGCATCATTTGCTTTACCCTCTTCTTCTTCTGCAACACG
GCCACTGTGTACAAGATATGTGCCTGGATGCAGCTCACCTCCGCTGCCTGCCTTGTGCTTGGCTGTATGATTTTCCC
TGATGGCTGGGACTCAGATGAAGTAAAACGGATGTGTGGAGAAAAGACAGACAAGTACACTCTTGGGGCTTGCTCAG
TCCGCTGGGCATACATCCTGGCTATTATTGGAATTTTGGATGCCCTGATCCTCTCATTTCTAGCATTTGTGCTTGGT
AATCGACAAGACAGCTTGATGGCAGAGGAACTGAAGGCAGAAAACAAAGTTCTGCTAAGCCAATATTCTCTAGAATG
AGCACAAAACAAATCGAATAACAGCTAAACAAATCGAATAACAGCTAAACGAATCGAATAACAGCTTTTGTACATCA
ACATCAAGAAGGAATACGCCTGAGAGAGATCAGAGTATATAGATGAATATGAACAAGAATGGAACATTCACTTGTCA
ACGCACTTTCTAAATCTAGATCAGCAGAGATGGGAGTGATTTTCTGGAAAGAGATGTGATCATGGATTAAACACCAG
CTCATTGGAAACTCATTGGATGAGATCAGAAAACGTTCATGAAAAATCATATTCAGGAAATAAGGAAGAGGAATATA
AATGCTCTAGAGTTAACATGTAAAATATATACGTACTGAGGTTTGTAAACTGTCCTTTTTAAATCAAACTGAAAACA
AAAAGCTTTAACCTTTCAACAGAATTTTTAAAAAGGCAGTTAGTTCTAAATTATTCCTATCTCAATAGCCAAGAGGC
TGATCAAGCGTCATTTATTGAGGAAGCATCTTAGAAAATGCCTCTGAATGTTTTCATAGGAGCCGTGACCTTTGGTT
CTTCATCTCTACCATTCATTTACTTCACTGTGTAATTAGTTACAACCACTCAGTTATTAAGAGACGTAACGCTTCAA
ACTTTTTACCAAGTCTGTGTTCTGTTTAATCTGTCCATACAAGTTATTACTGAGAAAGTGTTTATGCCATATACTAT
TACTCCATCAAGCTGTATATTACAGGAAGTACATCTTTACATCATAGGTTCCCAAGCAACATAGATTTCCCTATCTT
TCAGGAAACAGCATCAAGGAACTCTGAAAAATATAGAAAAAGTTCATTTTCACCTTGGAAGCTCACGTGTAATATTA
TAGGCTACTATCAAATAAACACTTTTTTTCTAATTCTCCCTAGTATATGCATAGGAATTTAATATACTTTATAAATA
AGTATCTAAAATGTCTCCTACTTTTTTCCTATTTCTTTGCCATACATGTTATCAGAAATCCATGTCTTCTATTTCCC
TTACTGATGGGCACTCATTTTTATTTTTTTAAAAATCATTCCATTAAACATATTTCTAAATAATAGTAAGTGGTACT
AACAAAATAAATAATAATTTAATAGCCTTAGAAATAAATGACTGTATACTTATACAGGTTGAAAAAAACTCGGTAGG
AATAAGTTACCTTTTTGTTTACTAATGTTGGTTTCAAAAATACTCAGATTCATTTTAGTTGGCTGACATCTGGAAGT
AGTTAACAACTAACCAGTGGACTTCAACAATCATTTGCTCCCAGGCTTCCCCCATCATCACCCTCACCACATATCCT
GCTAATATCCAACAACAAACAAATATTTAATATTGAAATAGCCCATTGCCTGAGAATGAACACAAGCTAAAATACAT
GCAAGGGTACTTAATGGAAGCCAAACCATGTTCTATACCTAAGGAGAAAACATGGACATGTAGAATGCTTTTATTCA
TGTATTCAAAATCAGAACAAATCAGTGTATATCACTAGAACATCAGATGGAGGATAACACAAGAAGTGATACAGATC
AGGGTTCACTTCTCTTACCCTCTCTCTGTTAGGACCACATTCCTATTTTAGCCAAATGTTTCTGGTACGGGCCATCT
TTTCACCATAAATGGCATTATGTTTCAAATGGCTAAAAGCATATTATGGGTATGCTCAAAGGAGTAAAACCCAATTC
ACAGAGATGTGGCTTTTCTAAAGAACCAAATTAAGGGAATACTTAGTATCTACAACTAAAGTATTAGTCATTCTGAG
GATTATTTGTTGCTTTAAGTATTAGCTCCCTACTACATCCATAACACCCTACTTACTAAATTTAATTACACACAACT
TTTCAAGAATTCGTATTTTATTTGAAGGGAGGTACCTGTCTACTTTATCTACAATAAAAACAAAGGGTATTGGCTTT
CTCTAATCCATGCAAACTACAAATTCCATCGGGAGTCCTACATCACTAACAGTGGTATGAACAAAACTAAGAAAGTA
CTTCCTATCCACATGTGAATGTTTTAAAAAAGTTTTTGCCATAAAACCTAAGTGTAATTTAGCATACCACAGTGCTC
TGAAGATGGGTCATTGACGATGTACCATTTGTATATAGGTAATACACATGTAAATCACTAATTGTTAATTAAATATA
AGAAGTAGGTTTTTATCTTTTTAAAAAAAAAACAAAAAAGGTGACTCCCTTTCTCATTCTGTTCTGTTGTATTGCGT
CCAAAAGTTGTGTGTAATTTTTTTAAGGTCCAAGAAATGTAAAGAAATTTGTTGGAATACCTGAATTTCTGTAAAAA
AATAAAAATAAAAATAAGATTTTGTTACTTAAAA

FIGURE 3

CTCCTGTATAGGCGGGCACCATGGGCTCCTGCTCCGGCCGCTGCGCGCTCGTCGTCCTCTGCGCTTTTCAGCTGGTC
GCCGCCCTGGAGAGGCAGGTGTTTGACTTCCTGGGCTACCAGTGGGCGCCCATCCTGGCCAACTTTGTCCACATCAT
CATCGTCATCCTGGGACTCTTCGGCACCATCCAGTACCGGCTGCGCTATGTCATGGTGTACACGCTGTGGGCAGCCG
TCTGGGTCACCTGGAACGTCTTCATCATCTGCTTCTACCTGGAAGTCGGTGGCCTCTTAAAGGACAGCGAGCTACTG
ACCTTCAGCCTCTCCCGGCATCGCTCCTGGTGGCGTGAGCGCTGGCCAGGCTGTCTGCATGAGGAGGTGCCAGCAGT
GGGCCTCGGGGCCCCCCATGGCCAGGCCCTGGTGTCAGGTGCTGGCTGTGCCCTGGAGCCCAGCTATGTGGAGGCCC
TACACAGTTGCCTGCAGATCCTGATCGCGCTTCTGGGCTTTGTCTGTGGCTGCCAGGTGGTCAGCGTGTTTACGGAG
GAAGAGGACAGCTTTGATTTCATTGGTGGATTTGATCCATTTCCTCTCTACCATGTCAATGAAAAGCCATCCAGTCT
CTTGTCCAAGCAGGTGTACTTGCCTGCGTAAGTGAGGAAACAGCTGATCC

FIGURE 4

TGGGGGCCCCCCAGGCTCGCGCGTGGAGCGAAGCAGCATGGGCAGTCGGTGCGCGCTGGCCCTGGCGGTGCTCTCGG
CCTTGCTGTGTCAGGTCTGGAGCTCTGGGGTGTTCGAACTGAAGCTGCAGGAGTTCGTCAACAAGAAGGGGCTGCTG
GGGAACCGCAATTGCTGCCGCGGGGGCGCGGGGCCACCGCCGTGCGCCTGCCGGACCTTCTTCCGCGTGTGCCTCAA
GCACTACCAGGCCAGCGTGTCCCCCGAGCCGCCCTGCACCTACGGCAGCGCCGTCACCCCCGTGCTGGGCGTCGACT
CCTTCAGTCTGCCCGACGGCGGGGGCGCCGACTCCGCGTTCAGCAACCCCATCCGCTTCCCCTTCGGCTTCACCTGG
CCGGGCACCTTCTCTCTGATTATTGAAGCTCTCCACACAGATTCTCCTGATGACCTCGCAACAGAAAACCCAGAAAG
ACTCATCAGCCGCCTGGCCACCCAGAGGCACCTGACGGTGGGCGAGGAGTGGTCCCAGGACCTGCACAGCAGCGGCC
GCACGGACCTCAAGTACTCCTACCGCTTCGTGTGTGACGAACACTACTACGGAGAGGGCTGCTCCGTTTTCTGCCGT
CCCCGGGACGATGCCTTCGGCCACTTCACCTGTGGGGAGCGTGGGGAGAAAGTGTGCAACCCTGGCTGGAAAGGGCC
CTACTGCACAGAGCCGATCTGCCTGCCTGGATGTGATGAGCAGCATGGATTTTGTGACAAACCAGGGGAATGCAAGT
GCAGAGTGGGCTGGCAGGGCCGGTACTGTGACGAGTGTATCCGCTATCCAGGCTGTCTCCATGGCACCTGCCAGCAG
CCCTGGCAGTGCAACTGCCAGGAAGGCTGGGGGGGCCTTTTCTGCAACCAGGACCTGAACTACTGCACACACCATAA
GCCCTGCAAGAATGGAGCCACCTGCACCAACACGGGCCAGGGGAGCTACACTTGCTCTTGCCGGCCTGGGTACACAG
GTGCCACCTGCGAGCTGGGGATTGACGAGTGTGACCCCAGCCCTTGTAAGAACGGAGGGAGCTGCACGGATCTCGAG
AACAGCTACTCCTGTACCTGCCCACCCGGCTTCTACGGCAAAATCTGTGAATTGAGTGCCATGACCTGTGCGGACGG
CCCTTGCTTTAACGGGGGTCGGTGCTCAGACAGCCCCGATGGAGGGTACAGCTGCCGCTGCCCCGTGGGCTACTCCG
GCTTCAACTGTGAGAAGAAAATTGACTACTGCAGCTCTTCACCCTGTTCTAATGGTGCCAAGTGTGTGGACCTCGGT
GATGCCTACCTGTGCCGCTGCCAGGCCGGCTTCTCGGGGAGGCACTGTGACGACAACGTGGACGACTGCGCCTCCTC
CCCGTGCGCCAACGGGGGCACCTGCCGGGATGGCGTGAACGACTTCTCCTGCACCTGCCCGCCTGGCTACACGGGCA
GGAACTGCAGTGCCCCCGTCAGCAGGTGCGAGCACGCACCCTGCCACAATGGGGCCACCTGCCACGAGAGGGGCCAC
CGCTATGTGTGCGAGTGTGCCCGAGGCTACGGGGGTCCCAACTGCCAGTTCCTGCTCCCCGAGCTGCCCCCGGGCCC
AGCGGTGGTGGACCTCACTGAGAAGCTAGAGGGCCAGGGCGGGCCATTCCCCTGGGTGGCCGTGTGCGCCGGGGTCA
TCCTTGTCCTCATGCTGCTGCTGGGCTGTGCCGCTGTGGTGGTCTGCGTCCGGCTGAGGCTGCAGAAGCACCGGCCC
CCAGCCGACCCCTGCCGGGGGGAGACGGAGACCATGAACAACCTGGCCAACTGCCAGCGTGAGAAGGACATCTCAGT
CAGCATCATCGGGGCCACGCAGATCAAGAACACCAACAAGAAGGCGGACTTCCACGGGGACCACAGCGCCGACAAGA
ATGGCTTCAAGGCCCGCTACCCAGCGGTGGACTATAACCTCGTGCAGGACCTCAAGGGTGACGACACCGCCGTCAGG
GACGCGCACAGCAAGCGTGACACCAAGTGCCAGCCCCAGGGCTCCTCAGGGGAGGAGAAGGGGACCCCGACCACACT
CAGGGGTGGAGAAGCATCTGAAAGAAAAAGGCCGGACTCGGGCTGTTCAACTTCAAAAGACACCAAGTACCAGTCGG
TGTACGTCATATCCGAGGAGAAGGATGAGTGCGTCATAGCAACTGAGGTGTAAAATGGAAGTGAGATGGCAAGACTC
CCGTTTCTCTTAAAATAAGTAAAATTCCAAGGATATATGCCCCAACGAATGCTGCTGAAGAGGAGGGAGGCCTCGTG
GACTGCTGCTGAGAAACCGAGTTCAGACCGAGCAGGTTCTCCTCCTGAGGTCCTCGACGCCTGCCGACAGCCTGTCG
CGGCCCGGCCGCCTGCGGCACTGCCTTCCGTGACGTCGCCGTTGCACTATGGACAGTTGCTCTTAAGAGAATATATA
TTTAAATGGGTGAACTGAATTACGCATAAGAAGCATGCACTGCCTGAGTGTATATTTTGGATTCTTATGAGCCAGTC
TTTTCTTGAATTAGAAACACAAACACTGCCTTTATTGTCCTTTTTGATACGAAGATGTGCTTTTTCTAGATGGAAAA
GATGTGTGTTATTTTTTGGATTTGTAAAAATATTTTTCATGATATCTGTAAAGCTTGAGTATTTTGTGATGTTCGTT
TTTTATAATTTAAATTTTGGTAAATATGTACAAAGGCACTTCGGGTCTATGTGACTATATTTTTTTGTATATAAATG
TATTTATGGAATATTGTGCAAATGTTATTTGAGTTTTTTACTGTTTTGTTAATGAAGAAATTCCTTTTTAAAATATT
TTTCCAAAATAAATTTTATGAATGACAAAAAAAAAAAAAAAAAAAAAAAAAAAAAAAAAAAAAAAAAAAAAAAAAAAA
AAAAAAA

FIGURE 5

GCGCCTTGCCCGCGGCCCCGCCGGGCCTCAGGCCCGGGGACCCTCAGCGCTACCTTTTGCCTCCGGCTCTGGGACTG
CTCGTGGCCGCGGGCGTGGCCGGCGCTGCGCTCTTGCTGGTCCACGTGCGCCGCCGTGGCCACTCCCAGGATGCTGG
GTCTCGCTTGCTGGCTGGGACCCCGGAGCCGTCAGTCCACGCACTCCCGGATGCACTCAACAACCTAAGGACGCAGG
AGGGTTCCGGGGATGGTCCGAGCTCGTCCGTAGATTGGAATCGCCCTGAAGATGTAGACCCTCAAGGGATTTATGTC
ATATCTGCTCCTTCCATCTACGCTCGGGAGGTAGCGACGCCCCTTTTCCCCCCGCTACACACTGGGCGCGCTGGGCA
GAGGCAGCACCTGCTTTTXXXXXXXXXXXXXXXXXXXXXXXXXXXXXXXXXXXXXXXXXXXXXXXXXXXXXXXXXXXXX
XXXXXXXXXXXXXCGGGCGTGGCCGGCGCTGCGCTCTTGNTGGTCCANGTGCGCNGCCGTGGCCAATCNCAGGATGC
TGGGTCNCGCTTNCTGGTTNGGACCCCGGNGCCGTNAGTCCACNCACTCCNNGATGCACTCAACAACCTAAGGACGC
AGGAGGGTTCCCGGGGATGGTCCGAGCTCGTCCGTAGATTGGAATCGCCCTGAAGATGTAGACCCTCACAGGGAGTG
TATGTAATXXXXXXXXXXXXXXXXXXXXXXXXXXXXXXXXXXXXXXXXXXXXXXXXXXTCCGCACGTGGAGTCAGAG
CGTGGATTTTTGTANNTGCTNGGTGGTGCCCAGTCTCTGCCCCNGAGGCTTTGGANTTCAATCTTGAAGGGGTGTNC
TGGGGGAACTTTACTGTTGCAAGTTGTAAATAATGGTTNTTTATATCGTNTTTTTTCGTCACCCCATCTCTGATAGA
AACACCTNTAAAGGNTATTATTGTGAGTCAAAAAAA

FIGURE 6A

CACACATACGCACGCACGATCTCACTTCGATCTATACACTGGAGGATTAAAACAAACAAACAAAAAAAACATTTCCT
TCGCTCCCCCTCCCTCTCCACTCTGAGAAGCAGAGGAGCCGCACGGCGAGGGGCCGCAGACCGTCTGGAAATGCGAA
TCCTAAAGCGTTTCCTCGCTTGCATTCAGCTCCTCTGTGTTTGCCGCCTGGATTGGGCTAATGGATACTACAGACAA
CAGAGAAAACTTGTTGAAGAGATTGGCTGGTCCTATACAGGAGCACTGAATCAAAAAAATTGGGGAAAGAAATATCC
AACATGTAATAGCCCAAAACAATCTCCTATCAATATTGATGAAGATCTTACACAAGTAAATGTGAATCTTAAGAAAC
TTAAATTTCAGGGTTGGGATAAAACATCATTGGAAAACACATTCATTCATAACACTGGGAAAACAGTGGAAATTAAT
CTCACTAATGACTACCGTGTCAGCGGAGGAGTTTCAGAAATGGTGTTTAAAGCAAGCAAGATAACTTTTCACTGGGG
AAAATGCAATATGTCATCTGATGGATCAGAGCATAGTTTAGAAGGACAAAAATTTCCACTTGAGATGCAAATCTACT
GCTTTGATGCGGACCGATTTTCAAGTTTTGAGGAAGCAGTCAAAGGAAAAGGGAAGTTAAGAGCTTTATCCATTTTG
TTTGAGGTTGGGACAGAAGAAAATTTGGATTTCAAAGCGATTATTGATGGAGTCGAAAGTGTTAGTCGTTTTGGGAA
GCAGGCTGCTTTAGATCCATTCATACTGTTGAACCTTCTGCCAAACTCAACTGACAAGTATTACATTTACAATGGCT
CATTGACATCTCCTCCCTGCACAGACACAGTTGACTGGATTGTTTTTAAAGATACAGTTAGCATCTCTGAAAGCCAG
TTGGCTGTTTTTTGTGAAGTTCTTACAATGCAACAATCTGGTTATGTCATGCTGATGGACTACTTACAAAACAATTT
TCGAGAGCAACAGTACAAGTTCTCTAGACAGGTGTTTTCCTCATACACTGGAAAGGAAGAGATTCATGAAGCAGTTT
GTAGTTCAGAACCAGAAAATGTTCAGGCTGACCCAGAGAATTATACCAGCCTTCTTGTTACATGGGAAAGACCTCGA
GTCGTTTATGATACCATGATTGAGAAGTTTGCAGTTTTGTACCAGCAGTTGGATGGAGAGGACCAAACCAAGCATGA
ATTTTTGACAGATGGCTATCAAGACTTGGGTGCTATTCTCAATAATTTGCTACCCAATATGAGTTATGTTCTTCAGA
TAGTAGCCATATGCACTAATGGCTTATATGGAAAATACAGCGACCAACTGATTGTCGACATGCCTACTGATAATCCT
GAACTTGATCTTTTCCCTGAATTAATTGGAACTGAAGAAATAATCAAGGAGGAGGAAGAGGGAAAAGACATTGAAGA
AGGCGCTATTGTGAATCCTGGTAGAGACAGTGCTACAAACCAAATCAGGAAAAAGGAACCCCAGATTTCTACCACAA
CACACTACAATCGCATAGGGACGAAATACAATGAAGCCAAGACTAACCGATCCCCAACAAGAGGAAGTGAATTCTCT
GGAAAGGGTGATGTTCCCAATACATCTTTAAATTCCACTTCCCAACCAGTCACTAAATTAGCCACAGAAAAAGATAT
TTCCTTGACTTCTCAGACTGTGACTGAACTGCCACCTCACACTGTGGAAGGTACTTCAGCCTCTTTAAATGATGGCT
CTAAAACTGTTCTTAGATCTCCACATATGAACTTGTCGGGGACTGCAGAATCCTTAAATACAGTTTCTATAACAGAA
TATGAGGAGGAGAGTTTATTGACCAGTTTCAAGCTTGATACTGGAGCTGAAGATTCTTCAGGCTCCAGTCCCGCAAC
TTCTGCTATCCCATTCATCTCTGAGAACATATCCCAAGGGTATATATTTTCCTCCGAAAACCCAGAGACAATAACAT
ATGATGTCCTTATACCAGAATCTGCTAGAAATGCTTCCGAAGATTCAACTTCATCAGGTTCAGAAGAATCACTAAAG
GATCCTTCTATGGAGGGAAATGTGTGGTTTCCTAGCTCTACAGACATAACAGCACAGCCCGATGTTGGATCAGGCAG
AGAGAGCTTTCTCCAGACTAATTACACTGAGATACGTGTTGATGAATCTGAGAAGACAACCAAGTCCTTTTCTGCAG
GCCCAGTGATGTCACAGGGTCCCTCAGTTACAGATCTGGAAATGCCACATTATTCTACCTTTGCCTACTTCCCAACT
GAGGTAACACCTCATGCTTTTACCCCATCCTCCAGACAACAGGATTTGGTCTCCACGGTCAACGTGGTATACTCGCA
GACAACCCAACCGGTATACAATGGTGAGACACCTCTTCAACCTTCCTACAGTAGTGAAGTCTTTCCTCTAGTCACCC
CTTTGTTGCTTGACAATCAGATCCTCAACACTACCCCTGCTGCTTCAAGTAGTGATTCGGCCTTGCATGCTACGCCT
GTATTTCCCAGTGTCGATGTGTCATTTGAATCCATCCTGTCTTCCTATGATGGTGCACCTTTGCTTCCATTTTCCTC
TGCTTCCTTCAGTAGTGAATTGTTTCGCCATCTGCATACAGTTTCTCAAATCCTTCCACAAGTTACTTCAGCTACCG
AGAGTGATAAGGTGCCCTTGCATGCTTCTCTGCCAGTGGCTGGGGGTGATTTGCTATTAGAGCCCAGCCTTGCTCAG
TATTCTGATGTGCTGTCCACTACTCATGCTGCTTCAGAGACGCTGGAATTTGGTAGTGAATCTGGTGTTCTTTATAA
AACGCTTATGTTTTCTCAAGTTGAACCACCCAGCAGTGATGCCATGATGCATGCACGTTCTTCAGGGCCTGAACCTT
CTTATGCCTTGTCTGATAATGAGGGCTCCCAACACATCTTCACTGTTTCTTACAGTTCTGCAATACCTGTGCATGAT
TCTGTGGGTGTAACTTATCAGGGTTCCTTATTTAGCGGCCCTAGCCATATACCAATACCTAAGTCTTCGTTAATAAC
CCCAACTGCATCATTACTGCAGCCTACTCATGCCCTCTCTGGTGATGGGGAATGGTCTGGAGCCTCTTCTGATAGTG
AATTTCTTTTACCTGACACAGATGGGCTGACAGCCCTTAACATTTCTTCACCTGTTTCTGTAGCTGAATTTACATAT
ACAACATCTGTGTTTGGTGATGATAATAAGGCGCTTTCTAAAAGTGAAATAATATATGGAAATGAGACTGAACTGCA
AATTCCTTCTTTCAATGAGATGGTTTACCCTTCTGAAAGCACAGTCATGCCCAACATGTATGATAATGTAAATAAGT
TGAATGCGTCTTTACAAGAAACCTCTGTTTCCATTTCTAGCACCAAGGGCATGTTTCCAGGGTCCCTTGCTCATACC
ACCACTAAGGTTTTTGATCATGAGATTAGTCAAGTTCCAGAAAATAACTTTTCAGTTCAACCTACACATACTGTCTC
TCAAGCATCTGGTGACACTTCGCTTAAACCTGTGCTTAGTGCAAACTCAGAGCCAGCATCCTCTGACCCTGCTTCTA
GTGAAATGTTATCTCCTTCAACTCAGCTCTTATTTTATGAGACCTCAGCTTCTTTTAGTACTGAAGTATTGCTACAA
CCTTCCTTTCAGGCTTCTGATGTTGACACCTTGCTTAAAACTGTTCTTCCAGCTGTGCCCAGTGATCCAATATTGGT
TGAAACCCCCAAAGTTGATAAAATTAGTTCTACAATGTTGCATCTCATTGTATCAAATTCTGCTTCAAGTGAAAACA
TGCTGCACTCTACATCTGTACCAGTTTTTGATGTGTCGCCTACTTCTCATATGCACTCTGCTTCACTTCAAGGTTTG
ACCATTTCCTATGCAAGTGAGAAATATGAACCAGTTTTGTTAAAAAGTGAAAGTTCCCACCAAGTGGTACCTTCTTT
GTACAGTAATGATGAGTTGTTCCAAACGGCCAATTTGGAGATTAACCAGGCCCATCCCCCAAAAGGAAGGCATGTAT
TTGCTACACCTGTTTTATCAATTGATGAACCATTAAATACACTAATAAATAAGCTTATACATTCCGATGAAATTTTA
ACCTCCACCAAAAGTTCTGTTACTGGTAAGGTATTTGCTGGTATTCCAACAGTTGCTTCTGATACATTTGTATCTAC
TGATCATTCTGTTCCTATAGGAAATGGGCATGTTGCCATTACAGCTGTTTCTCCCCACAGAGATGGTTCTGTAACCT
CAACAAAGTTGCTGTTTCCTTCTAAGGCAACTTCTGAGCTGAGTCATAGTGCCAAATCTGATGCCGGTTTAGTGGGT
GGTGGTGAAGATGGTGACACTGATGATGATGGTGATGATGATGATGACAGAGATAGTGATGGCTTATCCATTCATAA
GTGTATGTCATGCTCATCCTATAGAGAATCACAGGAAAAGGTAATGAATGATTCAGACACCCACGAAAACAGTCTTA
TGGATCAGAATAATCCAATCTCATACTCACTATCTGAGAATTCTGAAGAAGATAATAGAGTCACAAGTGTATCCTCA
GACAGTCAAACTGGTATGGACAGAAGTCCTGGTAAATCACCATCAGCAAATGGGCTATCCCAAAAGCACAATGATGG
AAAAGAGGAAAATGACATTCAGACTGGTAGTGCTCTGCTTCCTCTCAGCCCTGAATCTAAAGCATGGGCAGTTCTGA

FIGURE 6B

CAAGTGATGAAGAAAGTGGATCAGGGCAAGGTACCTCAGATAGCCTTAATGAGAATGAGACTTCCACAGATTTCAGT
TTTGCAGACACTAATGAAAAAGATGCTGATGGGATCCTGGCAGCAGGTGACTCAGAAATAACTCCTGGATTCCCACA
GTCCCCAACATCATCTGTTACTAGCGAGAACTCAGAAGTGTTCCACGTTTCAGAGGCAGAGGCCAGTAATAGTAGCC
ATGAGTCTCGTATTGGTCTAGCTGAGGGGTTGGAATCCGAGAAGAAGGCAGTTATACCCCTTGTGATCGTGTCAGCC
CTGACTTTTATCTGTCTAGTGGTTCTTGTGGGTATTCTCATCTACTGGAGGAAATGCTTCCAGACTGCACACTTTTA
CTTAGAGGACAGTACATCCCCTAGAGTTATATCCACACCTCCAACACCTATCTTTCCAATTTCAGATGATGTCGGAG
CAATTCCAATAAAGCACTTTCCAAAGCATGTTGCAGATTTACATGCAAGTAGTGGGTTTACTGAAGAATTTGAGACA
CTGAAAGAGTTTTACCAGGAAGTGCAGAGCTGTACTGTTGACTTAGGTATTACAGCAGACAGCTCCAACCACCCAGA
CAACAAGCACAAGAATCGATACATAAATATCGTTGCCTATGATCATAGCAGGGTTAAGCTAGCACAGCTTGCTGAAA
AGGATGGCAAACTGACTGATTATATCAATGCCAATTATGTTGATGGCTACAACAGACCAAAAGCTTATATTGCTGCC
CAAGGCCCACTGAAATCCACAGCTGAAGATTTCTGGAGAATGATATGGAACATAATGTGGAAGTTATTGTCATGAT
AACAAACCTCGTGGAGAAAGGAAGGAGAAAATGTGATCAGTACTGGCCTGCCGATGGGAGTGAGGAGTACGGGAACT
TTCTGGTCACTCAGAAGAGTGTGCAAGTGCTTGCCTATTATACTGTGAGGAATTTTACTCTAAGAAACACAAAAATA
AAAAAGGGCTCCCAGAAAGGAAGACCCAGTGGACGTGTGGTCACACAGTATCACTACACGCAGTGGCCTGACATGGG
AGTACCAGAGTACTCCCTGCCAGTGCTGACCTTTGTGAGAAAGGCAGCCTATGCCAAGCGCCATGCAGTGGGGCCTG
TTGTCGTCCACTGCAGTGCTGGAGTTGGAAGAACAGGCACATATATTGTGCTAGACAGTATGTTGCAGCAGATTCAA
CACGAAGGAACTGTCAACATATTTGGCTTCTTAAAACACATCCGTTCACAAAGAAATTATTTGGTACAAACTGAGGA
GCAATATGTCTTCATTCATGATACACTGGTTGAGGCCATACTTAGTAAAGAAACTGAGGTGCTGGACAGTCATATTC
ATGCCTATGTTAATGCACTCCTCATTCCTGGACCAGCAGGCAAAACAAAGCTAGAGAAACAATTCCAGCTCCTGAGC
CAGTCAAATATACAGCAGAGTGACTATTCTGCAGCCCTAAAGCAATGCAACAGGGAAAAGAATCGAACTTCTTCTAT
CATCCCTGTGGAAAGATCAAGGGTTGGCATTTCATCCCTGAGTGGAGAAGGCACAGACTACATCAATGCCTCCTATA
TCATGGGCTATTACCAGAGCAATGAATTCATCATTACCCAGCACCCTCTCCTTCATACCATCAAGGATTTCTGGAGG
ATGATATGGGACCATAATGCCCAACTGGTGGTTATGATTCCTGATGGCCAAAACATGGCAGAAGATGAATTTGTTTA
CTGGCCAAATAAAGATGAGCCTATAAATTGTGAGAGCTTTAAGGTCACTCTTATGGCTGAAGAACACAAATGTCTAT
CTAATGAGGAAAAACTTATAATTCAGGACTTTATCTTAGAAGCTACACAGGATGATTATGTACTTGAAGTGAGGCAC
TTTCAGTGTCCTAAATGGCCAAATCCAGATAGCCCCATTAGTAAAACTTTTGAACTTATAAGTGTTATAAAAGAAGA
AGCTGCCAATAGGGATGGGCCTATGATTGTTCATGATGAGCATGGAGGAGTGACGGCAGGAACTTTCTGTGCTCTGA
CAACCCTTATGCACCAACTAGAAAAAGAAAATTCCGTGGATGTTTACCAGGTAGCCAAGATGATCAATCTGATGAGG
CCAGGAGTCTTTGCTGACATTGAGCAGTATCAGTTTCTCTACAAAGTGATCCTCAGCCTTGTGAGCACAAGGCAGGA
AGAGAATCCATCCACCTCTCTGGACAGTAATGGTGCAGCATTGCCTGATGGAAATATAGCTGAGAGCTTAGAGTCTT
TAGTTTAACACAGAAAGGGGTGGGGGACTCACATCTGAGCATTGTTTTCCTCTTCCTAAAATTAGGCAGGAAAATC
AGTCTAGTTCTGTTATCTGTTGATTTCCCATCACCTGACAGTAACTTTCATGACATAGGATTCTGCCGCCAAATTTA
TATCATTAACAATGTGTGCCTTTTTGCAAGACTTGTAATTTACTTATTATGTTTGAACTAAAATGATTGAATTTTAC
AGTATTTCTAAGAATGGAATTGTGGTATTTTTTTCTGTATTGATTTTAACAGAAAATTTCAATTTATAGAGGTTAGG
AATTCCAAACTACAGAAAATGTTTGTTTTTAGTGTCAAATTTTTAGCTGTATTTGTAGCAATTATCAGGTTTGCTAG
AAATATAACTTTTAATACAGTAGCCTGTAAATAAAACACTCTTCCATATGATATTCAACATTTTACAACTGCAGTAT
TCACCTAAAGTAGAAATAATCTGTTACTTATTGTAAATACTGCCCTAGTGTCTCCATGGACCAAATTTATATTTATA
ATTGTAGATTTTTATATTTTACTACTGAGTCAAGTTTTCTAGTTCTGTGTAATTGTTTAGTTTAATGACGTAGTTCA
TTAGCTGGTCTTACTCTACCAGTTTTCTGACATTGTATTGTGTTACCTAAGTCATTAACTTTGTTTCAGCATGTAAT
TTTAACTTTTGTGGAAAATAGAAATACCTTCATTTTGAAAGAAGTTTTTATGAGAATAACACCTTACCAAACATTGT
TCAAATGGTTTTTATCCAAGGAATTGCAAAAATAAATATAAATATTGCCATTAAAAAAAAAAAAAAAAAAAAAAAAA
AAAAAAAAAA

FIGURE 7

TGTAAGTAGGGTGGGACAGAGATGGCACCTGGGGGTTCTGAGGCACCCGCTCCTCTCTGAGACAGACAGGGATCAGG
AGCCGGACTGGGACCAGACCACCAGCAACACACCAGAGGATGTTCTCTAAATAAGACCATGGCACTTAAGAACATTA
ACTACCTTCTCATCTTCTACCTCAGTTTCTCACTGCTTATCTACATAAAAAATTCCTTTTGCAATAAAAACAACACC
AGGTGCCTCTCAAATTCTTGCCAAAACAATTCTACATGCAAAGATTTTTCAAAAGACAATGATTGTTCTTGTTCAGA
CACAGCCAATAATTTGGACAAAGACTGTGACAACATGAAAGACCCTTGCTTCTCCAATCCCTGTCAAGGAAGTGCCA
CTTGTGTGAACACCCCAGGAGAAAGGAGCTTTCTGTGCAAATGTCCTCCTGGGTACAGTGGACAATCTGTGAAACT
ACCATTGGTTCCTGTGGCAAGAACTCCTGCCAACATGGAGGTATTTGCCATCAGGACCCTATTTATCCTGTCTGCAT
CTGCCCTGCTGGATATGCTGGAAGATTCTGTGAGATAGATCACGATGAGTGTGCTTCCAGCCCTTGCCAAAATGGGG
CCGTGTGCCAGGATGGAATTGATGGTTACTCCTGCTTCTGTGTCCCAGGATATCAAGGCAGACACTGCGACTTGGAA
GTGGATGAATGTGCTTCAGATCCCTGCAAGAACGAGGCTACATGCCTCAATGAAATAGGAAGATATACTTGTATCTG
TCCCCACAATTATTCTGGTGTAAACTGTGAATTGGAAATTGACGAATGTTGGTCCCAGCCTTGTTTAAATGGTGCAA
CTTGTCAGGATGCTCTGGGGGCCTATTTCTGCGACTGTGCCCCTGGATTCCTGGGGGATCACTGTGAACTCAACACT
GATGAGTGTGCCAGTCAACCTTGTCTCCATGGAGGGCTGTGTGTGGATGGAGAAAACAGATATAGCTGTAACTGCAC
GGGTAGTGGATTCACAGGGACACACTGTGAGACCTTGATGCCTCTTTGTTGGTCAAAACCTTGTCACAATAATGCTA
CATGTGAGGACAGTGTTGACAATTACACTTGTCACTGCTGGCCTGGATACACAGGTGCCCAGTGTGAGATCGACCTC
AATGAATGCAATAGTAACCCCTGCCAGTCCAATGGGGAATGTGTGGAGCTGTCCTCAGAGAAACAATATGGACGCAT
CACTGGACTGCCTTCTTCTTTCAGCTACCATGAAGCCTCAGGTTATGTCTGTATCTGTCAGCCTGGATTCACAGGAA
TCCACTGCGAAGAAGACGTCAATGAATGTTCTTCAAACCCTTGCCAAAATGGTGGTACTTGTGAGAACTTGCCTGGG
AATTATACTTGCCATTGCCCATTTGATAACCTTTCTAGAACTTTTTATGGAGGAAGGGACTGTTCTGATATTCTCCT
GGGCTGTACCCATCAGCAATGTCTAAATAATGGAACATGCATCCCTCACTTCCAAGATGGCCAGCATGGATTCAGCT
GCCTGTGTCCATCTGGCTACACCGGGTCCCTGTGTGAAATCGCAACCACACTTTCATTTGAGGGCGATGGCTTCCTG
TGGGTCAAAAGTGGCTCAGTGACAACCAAGGGCTCAGTTTGTAACATAGCCCTCAGGTTTCAGACTGTTCAGCCAAT
GGCTCTTCTACTTTTCCGAAGCAACAGGGATGTGTTTGTGAAGCTGGAGCTGCTAAGTGGCTACATTCACTTATCAA
TTCAGGTCAATAATCAGTCAAAGGTGCTTCTGTTCATTTCCCACAACACCAGCGATGGAGAGTGGCATTTCGTGGAG
GTAATATTTGCAGAGGCTGTGACCCTTACCTTAATCGACGACTCCTGTAAGGAGAAATGCATCGCGAAAGCTCCTAC
TCCACTTGAAAGTGATCAATCAATATGTGCTTTTCAGAACTCCTTTTTGGGTGGTTTACCAGTGGGAATGACCAGCA
ATGGTGTTGCTCTGCTTAACTTCTATAATATGCCATCCACACCTTCGTTTGTAGGCTGTCTCCAAGACATTAAAATT
GATTGGAATCACATTACCCTGGAGAACATCTCGTCTGGCTCATCATTAAATGTCAAGGCAGGCTGTGTGAGAAAGGA
TTGGTGTGAAAGCCAACCTTGTCAAAGCAGAGGACGCTGCATCAACTTGTGGCTGAGTTACCAGTGTGACTGCCACA
GGCCCTATGAAGGCCCCAACTGTCTGAGAGAGTATGTGGCAGGCAGATTTGGCCAGGATGACTCCACTGGTTATGTC
ATCTTTACTCTTGATGAGAGCTATGGAGACACCATCAGCCTCTCCATGTTTGTCCGAACGCTTCAACCATCAGGCTT
ACTTCTAGCTTTGGAAAACAGCACTTATCAATATATCCGTGTCTGGCTAGAGCGCGGCAGACTAGCAATGCTGACTC
CAAACTCTCCCAAATTAGTAGTAAAATTTGTTCTTAATGATGGAAATGTCCACTTGATATCTTTGAAAATCAAGCCA
TATAAAATTGAACTGTATCAGTCTTCACAAAACCTAGGATTTATTTCTGCTTCTACGTGGAAAATCGAAAAGGGAGA
TGTCATCTACATTGGTGGCCTACCTGACAAGCAAGAGACTGAACTTAATGGTGGATTCTTCAAAGGCTGTATCCAAG
ATGTAAGACTAAACAACCAAAATCTGGAATTCTTTCCAAATCCAACAAACAATGCATCTCTCAATCCAGTTCTTGTC
AATGTAACCCAAGGCTGTGCTGGAGACAACAGCTGCAAGTCCAACCCCTGTCACAATGGAGGTGTTTGCCATTCCCG
GTGGGATGACTTCTCCTGTTCCTGTCCTGCCCTCACAAGTGGGAAAGCCTGTGAGGAGGTTCAGTGGTGTGGATTCA
GCCCGTGTCCTCACGGAGCCCAGTGCCAGCCGGTGCTTCAAGGATTTGAATGTATTGCAAATGCTGTTTTTAATGGA
CAAAGCGGTCAAATATTATTCAGAAGCAATGGGAATATTACCAGAGAACTCACCAATATCACATTTGGTTTCAGAAC
AAGGGATGCAAATGTAATAATATTGCATGCAGAAAAAGAGCCTGAATTTCTTAATATTAGCATTCAAGATTCCAGAT
TATTCTTTCAATTGCAAAGTGGCAACAGCTTTTATATGCTAAGTCTGACAAGTTTGCAGTCAGTGAATGATGGCACA
TGGCACGAAGTGACCCTTTCCATGACAGACCCACTGTCCCAGACCTCCAGGTGGCAAATGGAAGTGGACAACGAAAC
ACCTTTTGTGACCAGCACAATTGCTACTGGAAGCCTCAACTTTTTGAAGGATAATACAGATATTTATGTGGGAGACA
GAGCTATTGACAATATAAAGGGCCTGCAAGGGTGTCTAAGTACAATAGAAATCGGAGGCATTTATCTCTCTTACTTT
GAAAATGTTCATGGTTTCATTAATAAACCTCAGGAAGAGCAATTTCTCAAAATCTCTACCAATTCAGTGGTCACTGG
CTGTTTGCAGTTAAATGTCTGCAACTCCAACCCCTGTTTGCATGGAGGAAACTGTGAAGACATCTATAGCTCTTATC
ATTGCTCCTGTCCCTTGGGATGGTCAGGGAAACACTGTGAACTCAACATCGATGAATGCTTTTCAAACCCCTGTATC
CATGGCAACTGCTCTGACAGAGTTGCAGCCTACCACTGCACATGTGAGCCTGGATACACTGGTGTGAACTGTGAAGT
GGATATAGACAACTGCCAGAGTCACCAGTGTGCAAATGGAGCCACCTGCATTAGTCATACTAATGGCTATTCTTGCC
TCTGTTTTGGAAATTTTACAGGAAAATTTTGCAGACAGAGCAGATTACCCTCAACAGTCTGTGGGAATGAGAAGACA
AATCTCACTTGCTACAATGGAGGCAACTGCACAGAGTTCCAGACTGAATTAAAATGTATGTGCCGGCCAGGTTTTAC
TGGAGAATGGTGTGAAAAGGACATTGATGAGTGTGCCTCTGATCCGTGTGTCAATGGAGGTCTGTGCCAGGACTTAC
TCAACAAATTCCAGTGCCTCTGTGATGTTGCCTTTGCTGGCGAGCGCTGCGAGGTGGACGTAAGCAGCCTCTCCTTT
TATGTCTCTCTCTTATTCTGGCAGAATCTTTTTCAGCTTCTTTCTTACCTCATTTTGCGTATGAATGACGAGCCAGT
TGTTGAGTGGGGTGAACAGGAAGATTATTAACATACATTTGAACATTCCCAAATGAAAAAAAAAGCCATTGAATTTC
AAGAAATGCCTTGATTCATTTTAGATCTCTGGGGAAAAAAAAAAAAAAA

FIGURE 8

GCCTGCTGCCGCCTGGGCCCCGCCGAGCGGAGCTAGCGCCGCGCGCAGAGCACACGCTCGCGCTCCAGCTCCCCTCC

TGCGCGGTTCATGACTGTGTCCCCTGACCGCAGCCTCTGCGAGCCCCCGCCGCAGGACCACGGCCCGCTCCCCGCCG

CCGCGAGGGCCCCGAGCGAAGGAAGGAAGGGAGGCGCGCTGTGCGCCCCGCGGAGCCCGCGAACCCCGCTCGCTGCC

GGCTGCCCAGCCTGGCTGGCACCATGCTGCCCGCGCGCTGCGCCCGCCTGCTCACGCCCCACTTGCTGCTGGTGTTG

GTGCAGCTGTCCCCTGCTCGCGGCCACCGCACCACAGGCCCCAGGTTTCTAATAAGTGACCGTGACCCACAGTGCAA

CCTCCACTGCTCCAGGACTCAACCCAAACCCATCTGTGCCTCTGATGGCAGGTCCTACGAGTCCATGTGTGAGTACC

AGCGAGCCAAGTGCCGAGACCCGACCCTGGGCGTGGTGCATCGAGGTAGATGCAAAGATGCTGGCCAGAGCAAGTGT

CGCCTGGAGCGGGCTCAAGCCCTGGAGCAAGCCAAGAAGCCTCAGGAAGCTGTGTTTGTCCCAGAGTGTGGCGAGGA

TGGCTCCTTTACCCAGGTGCAGTGCCATACTTACACTGGGTACTGCTGGTGTGTCACCCCGGATGGGAAGCCCATCA

GTGGCTCTTCTGTGCAGAATAAAACTCCTGTATGTTCAGGTTCAGTCACCGACAAGCCCTTGAGCCAGGGTAACTCA

GGAAGGAAAGATGACGGGTCTAAGCCGACACCCACGATGGAGACCCAGCCGGTGTTCGATGGAGATGAAATCACAGC

CCCAACTCTATGGATTAAACACTTGGTGATCAAGGACTCCAAACTGAACAACACCAACATAAGAAATTCAGAGAAAG

TCTATTCGTGTGACCAGGAGAGGCAGAGTGCCCTGGAAGAGGCCCAGCAGAATCCCCGTGAGGGTATTGTCATCCCT

GAATGTGCCCCTGGGGGACTCTATAAGCCAGTGCAATGCCACCAGTCCACTGGCTACTGCTGGTGTGTGCTGGTGGA

CACAGGGCGCCCGCTGCCTGGGACCTCCACACGCTACGTGATGCCCAGTTGTGAGAGCGACGCCAGGGCCAAGACTA

CAGAGGCGGATGACCCCTTCAAGGACAGGGAGCTACCAGGCTGTCCAGAAGGGAAGAAAATGGAGTTTATCACCAGC

CTACTGGATGCTCTCACCACTGACATGGTTCAGGCCATTAACTCAGCAGCGCCCACTGGAGGTGGGAGGTTCTCAGA

GCCAGACCCCAGCCACACCCTGGAGGAGCGGGTAGTGCACTGGTATTTCAGCCAGCTGGACAGCAATAGCAGCAACG

ACATTAACAAGCGGGAGATGAAGCCCTTCAAGCGCTACGTGAAGAAGAAAGCCAAGCCCAAGAAATGTGCCCGGCGT

TTCACCGACTACTGTGACCTGAACAAAGACAAGGTCATTTCACTGCCTGAGCTGAAGGGCTGCCTGGGTGTTAGCAA

AGAAGGACGCCTCGTCTAAGGAGCAGAAAACCCAAGGGCAGGTGGAGAGTCCAGGGAGGCAGGATGGATCACCAGAC

ACCTAACCTTCAGCGTTGCCCATGGCCCTGCCACATCCCGTGTAACATAAGTGGTGCCCACCATGTTTGCACTTTTA

ATAACTCTTACTTGCGTGTTTTGTTTTTGGTTTCATTTTAAAACACCAATATCTAATACCACAGTGGGAAAAGGAAA

GGGAAGAAAGACTTTATTCTCTCTCTTATTGTAAGTTTTTGGATCTGCTACTGACAACTTTTAGAGGGTTTTGGGGG

GGTGGGGGAGGGTGTTGTTGGGGCCTGAGAAGAAAGAGATTTATATGCTGTATATAAATATATATGTAAATTGTATA

GTTCTTTTGTACAGGCATTGGCATTGCTGTTTGTTTATTTCTCTCCCTCTGCCTGCTGTGGGTGGTGGGCACTCTGG

ACACATAGTCCAGCTTTCTAAAATCCAGGACTCTATCCTGGGCCTACTAAACTTCTGTTTGGAGACTGACCCTTGTG

TATAAAGACGGGAGTCCTGCAATTGTACTGCGGACTCCACGAGTTCTTTTCTGGTGGGAGGACTATATTGCCCCATG

CCATTAGTTGTCAAAATTGATAAGTCACTTGGCTCTCGGCCTTGTCCAGGGAGGTTGGGCTAAGGAGAGATGGAAAC

TGCCCTGGGAGAGGAAGGGAGTCCAGATCCCATGAATAGCCCACACAGGTACCGGCTCTCAGAGGGTCCGTGCATTC

CTGCTCTCCGGACCCCCAAAGGGCCCAGCATTGGTGGGTGCACCAGTATCTTAGTGACCCTCGGAGCAAATTATCCA

CAAAGGATTTGCATTACGTCACTCGAAACGTTTTCATCCATGCTTAGCATCTACTCTGTATAACGCATGAGAGGGGA

GGCAAAGAAGAAAAGGACACACGGAAGGGCCTTTAAAAAAGTAGATATTTAATATCTAAGCAGGGGAGGGGACAGGA

CAGAAAGCCTGCACTGAGGGGTGCGGTGCCAACAGGGAAACTCTTCACCTCCCTGCAAACCTACCAGTGAGGCTCCC

AGAGACGCAGCTGTCTCAGTGCCCAGGGGCAGATTGGGTGTGACCTCTCCA

FIGURE 9

GCCTCACACGCTCCTAGAGGACCACCTCCTGAGAGAGTTCTTTCACCCCCTCTTCTTTCTCCAAGCTCCCCTCCTGC
TCTCCCTCCCTGCCCAATACAATGCATTCTTGAGTGGCAGCGTCTGGACTCCAGGCAGCCCCAGAGAACCGAAGCAA
GCCAAAGAGAGGACTGGAGCCAAGATACTGGTGGGGGAGATTGGATGCCTGGCTTTCTTTGAGGACATCTTTGGAGC
GAGGGTGGCTTTGGGGTGGGGGCTTGTGCTGCAGGGAATACAGCCAGGCCCCAAGATGGACACTTCTGGGCACTTCC
ATGACTCGGGGGTGGGGGACTTGGATGAAGACCCCAAGTGCCCCTGTCCATCCTCTGGGGATGAGCAGCAGCAGCAG
CAGCAGCAGCAACAGCAGCAGCAGCCACCACCGCCAGCGCCACCAGCAGCCCCCCAGCAGCCCCTGGGACCCTCGCT
GCAGCCTCAGCCTCCGCAGCTTCAGCAGCAGCAGCAGCAGCAGCAGCAGCAGCAGCAGCAGCAGCCACCGCATCCCC
TGTCTCAGCTCGCCCAACTCCAGAGCCAGCCCGTCCACCCTGGCCTGCTGCACTCCTCTCCCACCGCTTTCAGAGCT
CCACCTTCGTCCAACTCCACCGCCATCCTCCACCCTTCCTCCAGGCAAGGCAGCCAGCTCAATCTCAATGACCACTT
GCTTGGCCACTCTCCAAGTTCCACAGCTACAAGTGGGCCTGGCGGAGGCAGCCGGCACCGACAGGCCAGCCCCCTGG
TGCACCGGCGGGACAGCAACCCCTTCACGGAGATCGCCATGAGCTCCTGCAAGTATAGCGGTGGGGTCATGAAGCCC
CTCAGCCGCCTCAGCGCCTCCCGGAGGAACCTCATCGAGGCCGAGACTGAGGGCCAACCCCTCCAGCTTTTCAGCCC
TAGCAACCCCCCGGAGATCGTCATCTCCTCCCGGGAGGACAACCATGCCCACCAGACCCTGCTCCATCACCCTAATG
CCACCCACAACCACCAGCATGCCGGCACCGCCGCCAGCAGCACCACCTTCCCCAAAGCCAACAAGCGGAAAAACCAG
AACATTGGCTATAAGCTGGGACACAGGAGGGCCCCGTTTGAAAAGAGAAAGCGACTGAGTGACTATGCTCTGATTTT
TGGGATGTTTGGAATTGTTGTTATGGTGATAGAGACCGAGCTCTCTTGGGGTTTGTACTCAAAGGACTCCATGTTTT
CGTTGGCCCTGAAATGCCTTATCAGTCTGTCCACCATCATCCTTTTGGGCTTGATCATCGCCTACCACACACGTGAA
GCCCAGCTCTTCGTGATCGACAATGGCGCGGATGACTGGCGGATAGCCATGACCTACGAGCGCATCCTGTACATCAG
CCTGGAGATGCTGGTGTGCGCCATCCACCCCATTCCTGGCGAGTACAAGTTCTTCTGGACGGCTCGCCTGGCCTTCT
CCTACACACCCTCCCGGGCGGAGGCCGATGTGGACATCATCCTGTCTATCCCCATGTTCCTGCGCCTGTACCTGATC
GCCCGAGTCATGCTGCTGCACAGCAAGCTCTTCACCGATGCCTCGTCCCGCAGCATCGGGGCCCTCAACAAGATCAA
CTTCAACACCCGCTTTGTCATGAAGACGCTCATGACCATCTGCCCTGGCACTGTGCTGCTCGTGTTCAGCATCTCTC
TGTGGATCATTGCTGCCTGGACCGTCCGTGCCTGTGAAAGGTACCATGACCAGCAGGACGTAACTAGTAACTTTCTG
GGTGCCATGTGGCTCATCTCCATCACATTCCTTTCCATTGGTTATGGGGACATGGTGCCCCACACATACTGTGGGAA
AGGTGTCTGTCTCCTCACTGGCATCATGGGTGCAGGCTGCACTGCCCTTGTGGTGGCCGTGGTGGCCCGAAAGCTGG
AACTCACCAAAGCGGAGAAGCACGTTCATAACTTCATGATGGACACTCAGCTCACCAAGCGGATCAAGAATGCTGCA
GCCAATGTCCTTCGGGAAACATGGTTAATCTATAAACACACAAAGCTGCTAAAGAAGATTGACCATGCCAAAGTGAG
GAAACACCAGAGGAAGTTCCTCCAAGCTATCCACCAGTTGAGGAGCGTCAAGATGGAACAGAGGAAGCTGAGTGACC
AAGCCAACACTCTGGTGGACCTTTCCAAGATGCAGAATGTCATGTATGACTTAATCACAGAACTCAATGACCGGAGC
GAAGACCTGGAGAAGCAGATTGGCAGCCTGGAGTCGAAGCTGGAGCATCTCACCGCCAGCTTCAACTCCCTGCCGCT
GCTCATCGCCGACACCCTGCGCCAGCAGCAGCAGCAGCTCCTGTCTGCCATCATCGAGGCCCGGGGTGTCAGCGTGG
CAGTGGGCACCACCCACACCCCAATCTCCGATAGCCCCATTGGGGTCAGCTCCACCTCCTTCCCGACCCCGTACACA
AGTTCAAGCAGTTGCTAAATAAATCTCCCCACTCCAGAAGCATTAAAAAAAAAAAA

FIGURE 10

CGCAGCGGAGGTGAAGGACGTCCTTCCCCAGGAGCCGACTGGCCAATCACAGGCAGGAAGATGAAGGTTCTGTGGGC

TGCGTTGCTGGTCACATTCCTGGCAGGATGCCAGGCCAAGGTGGAGCAAGCGGTGGAGACAGAGCCGGAGCCCGAGC

TGCGCCAGCAGACCGAGTGGCAGAGCGGCCAGCGCTGGGAACTGGCACTGGGTCGCTTTTGGGATTACCTGCGCTGG

GTGCAGACACTGTCTGAGCAGGTGCAGGAGGAGCTGCTCAGCTCCCAGGTCACCCAGGAACTGAGGGCGCTGATGGA

CGAGACCATGAAGGAGTTGAAGGCCTACAAATCGGAACTGGAGGAACAACTGACCCCGGTGGCGGAGGAGACGCGGG

CACGGCTGTCCAAGGAGCTGCAGGCGGCGCAGGCCCGGCTGGGCGCGGACATGGAGGACGTGTGCGGCCGCCTGGTG

CAGTACCGCGGCGAGGTGCAGGCCATGCTCGGCCAGAGCACCGAGGAGCTGCGGGTGCGCCTCGCCTCCCACCTGCG

CAAGCTGCGTAAGCGGCTCCTCCGCGATGCCGATGACCTGCAGAAGCGCCTGGCAGTGTACCAGGCCGGGGCCCGCG

AGGGCGCCGAGCGCGGCCTCAGCGCCATCCGCGAGCGCCTGGGGCCCCTGGTGGAACAGGGCCGCGTGCGGGCCGCC

ACTGTGGGCTCCCTGGCCGGCCAGCCGCTACAGGAGCGGGCCCAGGCCTGGGGCGAGCGGCTGCGCGCGCGGATGGA

GGAGATGGGCAGCCGGACCCGCGACCGCCTGGACGAGGTGAAGGAGCAGGTGGCGGAGGTGCGCGCCAAGCTGGAGG

AGCAGGCCCAGCAGATACGCCTGCAGGCCGAGGCCTTCCAGGCCCGCCTCAAGAGCTGGTTCGAGCCCCTGGTGGAA

GACATGCAGCGCCAGTGGGCCGGGCTGGTGGAGAAGGTGCAGGCTGCCGTGGGCACCAGCGCCGCCCCTGTGCCCAG

CGACAATCACTGAACGCCGAAGCCTGCAGCCATGCGACCCCACGCCACCCCGTGCCTCCTGCCTCCGCGCAGCCTGC

AGCGGGAGACCCTGTCCCCGCCCCAGCCGTCCTCCTGGGGTGGACCCTAGTTTAATAAAGATTCACCAAGTTTCACGC

FIGURE 11

ATGGGTAGCCGGGCGCGGGGCGGGGCCGCGGGGCCGCCGCTTAAAGAAACTTGTTGCGGGTCCCGCAGCGGGACCCG
AGCCTCGGCGGCGGCGGCGGCGGCGGCAGGGGCGAGGGTCGGGGCCACCGCGCGGCGACCTCGGGTCCCGGAGCGAC
CGCAGGGCAGCCCCGGGCGCCGGCCCCGGTGCGCGTCTCCTGTGCGCGCCCCTCCGCGCGCGGCCCCGATGCTGGAC
ATGAGCGAGGCCCGCTCCCAGCCGCCCTGCAGCCCGTCCGGCACCGCCAGCTCCATGTCGCACGTGGAGGACTCGGA
CTCGGACGCGCCGCCGTCTCCCGCCGGCTCCGAGGGCCTGGGCCGCGCGGGGGTCGCGGTGGGGGGCGCCGGGGCG
ACCCGGCGGAGGCGGCGGACGAGCGCTTCCCGGCCTGCATCCGCGACGCCGTGTCGCAGGTGCTCAAGGGCTACGAC
TGGAGTCTGGTGCCCATGCCGGTGCGCGGCGGCGGCGGCGGCGCGCTCAAAGCCAAGCCGCATGTGAAGCGGCCCAT
GAACGCATTCATGGTGTGGGCGCAGGCGGCGCGCCGCAAGCTGGCCGACCAGTACCCGCACCTGCACAACGCCGAGC
TCAGCAAGACGCTGGGCAAGCTGTGGCGCTTGCTGAGCGAGAGCGAGAAGCGGCCCTTCGTGGAGGAGGCAGAGCGC
CTTCGCGTGCAGCACAAGAAGGACCACCCCGACTACAAGTACCAGCCACGGCGCAGGAAGAGCGCCAAAGCCGGCCA
CAGCGACTCCGACTCGGGCGCGGAGCTGGGACCCCACCCTGGCGGCGGTGCCGTGTACAAGGCTGAAGCAGGGCTTG
GAGATGGGCACCACCATGGCGACCACACAGGGCAGACCCACGGGCCGCCCACCCCGCCCACCACCCCCAAGACGGAG
CTGCAGCAGGCGGGCGCCAAGCCGGAGCTGAAGCTGGAGGGACGCCGGCCGGTGGACAGCGGGCGCCAGAACATCGA
CTTCAGCAACGTGGACATCTCGGAGCTCAGCAGCGAGGTCATGGGCACCATGGACGCCTTCGACGTCCACGAGTTCG
ACCAGTACCTGCCCCTGGGCGGCCCCGCCCCACCCGAGCCGGGCCAGGCCTATGGGGGCGCCTACTTCCACGCCGGG
GCGTCCCCCGTGTGGGCCCACAAGAGTGCCCCGTCGGCCTCCGCGTCGCCCACCGAGACGGGTCCCCCACGGCCGCA
CATCAAGACGGAGCAGCCGAGCCCCGGCCACTACGGCGACCAGCCCCGAGGCTCGCCCGACTACGGTTCCTGCAGCG
GCCAGTCCAGCGCCACCCCGGCCGCCCCCGCCGGCCCCTTCGCCGGCTCACAGGGCGACTATGGCGACCTGCAGGCC
TCCAGCTACTATGGTGCCTACCCTGGCTACGCACCCGGCCTCTACCAGTACCCCTGCTTCCACTCGCCGCGCCGGCC
CTACGCCTCACCCCTGCTCAACGGCCTGGCCCTGCCGCCCGCCCACAGCCCCACCAGTCACTGGGACCAGCCGGTGT
ACACCACCCTGACCAGGCCCTGA

FIGURE 12

GTTCTAGATCGTTTCCCCGCGCGCAGGTCCGCGGGGAGGGGCGGCCTGCCGACCGGCCCACCCCAGGGCGTTCCTGA
AGGGCGTCCTCGGCCGCCCCCACCGCCTCCCAGATGTACTATGCGGTTTCCCAGGCGCGCGTGAACGCGGTCCCCGG
GACCATGCTGCGGCCACAGCGGCCCGGAGACTTGCAGCTCGGGGCCTCCCTCTACGAGCTGGTGGGCTACAGGCAGC
CGCCCTCCTCCTCCTCCTCCTCCACCTCCTCCACCTCCTCCACTTCCTCCTCCTCCACGACGGCCCCCCTCCTCCCC
AAGGCTGCGCGCGAGAAGCCGGAGGCGCCGGCCGAGCCTCCAGGCCCCGGGCCCGGGTCAGGCGCGCACCCGGGCGG
CAGCGCCCGGCCGGACGCCAAGGAGGAGCAGCAGCAGCAGCTGCGGCGCAAGATCAACAGCCGCGAGCGGAAGCGCA
TGCAGGACCTGAACCTGGCCATGGACGCCCTGCGCGAGGTCATCCTGCCCTACTCAGCGGCGCACTGCCAGGGCGCG
CCCGGCCGCAAGCTCTCCAAGATAGCCACGCTGCTGCTCGCCCGCAACTACATCCTACTGCTGGGCAGCTCGCTGCA
GGAGCTGCGCCGCGCGCTGGGCGAGGGCGCCGGGCCCGCCGCGCCGCGCCTGCTGCTGGCCGGGCTGCCCCTGCTCG
CCGCCGCGCCCGGCTCCGTGCTGCTGGCGCCCGGCGCCGTAGGACCCCCCGACGCGCTGCGCCCCGCCAAGTACCTG
TCGCTGGCGCTGGACGAGCCGCCGTGCGGCCAGTTCGCTCTCCCCGGCGGCGGCGCAGGCGGCCCCGGCCTCTGCAC
CTGCGCCGTGTGCAAGTTCCCGCACCTGGTCCCGGCCAGCCTGGGCCTGGCCGCCGTGCAGGCGCAATTCTCCAAGT
GAGGGCGGGTCTGGGCCTGGGGCGCGACCTCGGCCCGGCCTCCCTTCGCTCAGCTTCTCCGCGCCCCTGCTCCCTGC
GTCTGGGAGAGCGAGGCCGAGCAAGGAAAGCATTTCGAACCTTCCAGTCCAGAGGAAGGGACTGTCGGGCACCCCCT
TCCCCGCCCCCACCCCTGGGACGTTAAAGTGACCAGAGCGGATGTTCGATGGCGCCTCGGGGCAGTTTGGGGTTCTG
GGTCGGTTCCAGCGGCTTTAGGCAGAAAGTGCTCGCTCTCACCCAGCACATCTCTCTCCTTGTCCCTGGAGTTGCGC
GCTTCGCGGGGCCGATGTAGAACTTAGGGCGCCTTGCCGTGGTTGGCGCGCCCCGGGTGCAGCGAGAGGCCATCCCC
GAGCGCTACCTCCCCGGAGCGGAGCACGCGGGCTCCCAGTACTAGGGGCTGCGCTCGAGCAGTGGCGGGGGCGGAGG
GGTGGTTCTTTTCCTTCTCCTCCGCCAGAGGCCACGGGCGCCCTTGTTCCCGCCGGCCAGGTCCTATCAAAGGAGGC
TGCCGGAACTCAAGAGGCAGAAAAAGACCAGTTAGGCGGTGCAGACGGTCTGGGACGTGGCAGACGGACGGACCCTC
GGCGGACAGGTGGTCGGCGTCGGGGTGCGGTGGGTAGGGGCGAGGACAACGCAGGGTGCGCTGGGTTGGGACGTGGG
TCCACTTTTGTAGACCAGCTGTTTGGAGAGCTGTATTTAAGACTCGCGTATCCAGTGTTTTGTCGCAGAGAGTTTTC
ACTCTTAAATCCTGGGGGTTTCTTAGAAAGCAACTTAGAACTCGAGATTCACCTTTCGTTTCCCTTTCCCCAAAAGT
AGCGTAACCAACATTTAAGCTTGCTTAAAAACGAAAACCAACCGCCTTGCATCCAGTGTTCCCGATTTACTAAAATA
GGTAACCAGGCGTCTCACAGTCGCCGTCCTGTCAAGAGCGCTAATGAACGTTCTCATTAACACGCAGGAGTACCGGG
AGCCCTGAACCGCCCGCTGCTCGGCGGATCCCAGCTGCGGTGGCGACGGCGGGAAGGCGCTTTCCGCTGTTCCTCAG
CGGGCCGGGCCCTTGACCAGCGCGGCCCGCAGGTCTTCCTTCTCGCCGTCTTGCAGTTGAAGAGCTACATACGTAGT
CAGTTTCGATTTGTTACAGACGTTAACAAATTCCTTTACCCAAGGTTATGCTATGACCTTTCCGCAGTTTACTTTGA
TTTTCTATGTTTAAGGTTTTGGTTGTTGGTAGTAGCCGAATTTAACTGGCACTTTATTTTACTTCTAACCTTGTTTC
CTGACGGTGTACAGAATCAACAAAATAAAACATTTAAAGTCTGATTTTTTAAAAAAAAAAAAAAA

FIGURE 13

CCCTGAGGCTTTTCGGAGCGAGCTCCTCAAATCGCATCCAGATTTTCGGGTCCGAGGGAAGGAGGACCCTGCGAAAG
CTGCGACGACTATCTTCCCCTGGGGCCATGGACTCGGACGCCAGCCTGGTGTCCAGCCGCCCGTCGTCGCCAGAGCC
CGATGACCTTTTTCTGCCGGCCCGGAGTAAGGGCAGCAGCGGCAGCGCCTTCACTGGGGGCACCGTGTCCTCGTCCA
CCCCGAGTGACTGCCCGCCGGAGCTGAGCGCCGAGCTGCGCGGCGCTATGGGCTCTGCGGGCGCGCATCCTGGGGAC
AAGCTAGGAGGCAGTGGCTTCAAGTCGTCCTCGTCCAGCACCTCGTCGTCTACGTCGTCGGCGGCTGCGTCGTCCAC
CAAGAAGGACAAGAAGCAAATGACAGAGCCGGAGCTGCAGCAGCTGCGTCTCAAGATCAACAGCCGCGAGCGCAAGC
GCATGCACGACCTCAACATCGCCATGGATGGCCTCCGCGAGGTCATGCCGTACGCACACGGCCCTTCGGTGCGCAAG
CTTTCCAAGATCGCCACGCTGCTGCTGGCGCGCAACTACATCCTCATGCTCACCAACTCGCTGGAGGAGATGAAGCG
ACTGGTGAGCGAGATCTACGGGGGCCACCACGCTGGCTTCCACCCGTCGGCCTGCGGCGGCCTGGCGCACTCCGCGC
CCCTGCCCGCCGCCACCGCGCACCCGGCAGCAGCAGCGCACGCCGCACATCACCCCGCGGTGCACCACCCCATCCTG
CCGCCCGCCGCCGCAGCGGCTGCTGCCGCCGCTGCAGCCGCGGCTGTGTCCAGCGCCTCTCTGCCCGGATCCGGGCT
GCCGTCGGTCGGCTCCATCCGTCCACCGCACGGCCTACTCAAGTCTCCGTCTGCTGCCGCGGCCGCCCCGCTGGGG
GCGGGGGCGGCGGCAGTGGGGCGAGCGGGGGCTTCCAGCACTGGGGCGGCATGCCCTGCCCCTGCAGCATGTGCCAG
GTGCCGCCGCCGCACCACCACGTGTCGGCTATGGGCGCCGGCAGCCTGCCGCGCCTCACCTCCGACGCCAAG<u>TGA</u>GC
CGACTGGCGCCGGCGCGTTCTGGCGACAGGGGAGCCAGGGGCCGCGGGGAAGCGAGGACTGGCCTGCGCTGGGCTCG
GGAGCTCTGTCGCGAGGAGGGGCGCAGGACCATGGACTGGGGGTGGGGCATGGTGGGGATTCCAGCATCTGCGAACC
CAAGCAATGGGGGCGCCCACAGAGCAGTGGGAGTGAGGGGATGTTCTCTCCGGGACCTGATCGAGCGCTGTCTGGC
TTTAACCTGAGCTGGTCCAGTAGACATCGTTTTATGAAAAGGTACCGCTGTGTGCATTCCTCACTAGAACTCATCCG
ACCCCCGACCACCACCTCCGGGAAAAGATTCTAAAAACTTCTTTCCCTGAGAGCGTGGCCTGACTTGCAGACTCGGC
TTGGGCAGCACTTCGGGGGGGGAGGGGGTGTTATGGAGGGGGACACATTGGGGCCTTGCTCCTCTTCCTCCTTTCT
TGGCGGGTGGAGACTCCGGGTAGCCGCACTGCAGAAGCAACAGCCCGACCGCGCCCTCCAGGGTCGTCCCTGGCCC
AAGGCCAGGGGCCACAAGTTAGTTGGAAGCCGGCGTTCGGTATCAGAAGCGCTGATGGTCATATCCAATCTCAATAT
CTGGGTCAATCCACACCCTCTTAGAACTGTGGCCGTTCCTCCCTGTCTCTCGTTGATTTGGGAGAATATGGTTTTCT
AATAAATCTGTGGATGTTCCTTCTTCAACAGTATGAGCAAGTTTATAGACATTCAGAGTAGAACCACTTGTGGATTG
GAATAACCCAAAACTGCCGATTTCAGGGGCGGGTGCATTGTAGTTATTATTTTAAAATAGAAACTACCCCACCGACT
CATCTTTCCTTCTCTAAGCACAAAGTGATTTGGTTATTTTGGTACCTGAGAACGTAACAGAATTAAAAGGCAGTTGC
TGTGGAAACAGTTTGGGTTATTTGGGGGTTCTGTTGGCTTTTTAAAATTTTCTTTTTTGGATGTGTAAATTTATCAA
TGATGAGGTAAGTGCGCAATGCTAAGCTGTTTGCTCACGTGACTGCCAGCCCCATCGGAGTCTAAGCCGGCTTTCCT
CTATTTTGGTTTATTTTTGCCACGTTTAACACAAATGGTAAACTCCTCCACGTGCTTCCTGCGTTCCGTGCAAGCCG
CCTCGGCGCTGCCTGCGTTGCAAACTGGGCTTTGTAGCGTCTGCCGTGTAACACCCTTCCTCTGATCGCACCGCCCC
TCGCAGAGAGTGTATCATCTGTTTTATTTTTGTAAAAACAAAGTGCTAAATAATATTTATTACTTGTTTGGTTGCAA
AAACGGAATAAATGACTGAGTGTTGAGATTTTAAATAAAATTTAAAGT

FIGURE 14A

GGGTTTGGGGAGCAGGAGGCAGACATGTGTTGCTTTGCACGTCATCTGGTCCTTCCACCTGGCTGGGCATGGGATGG
TGACCTCAGCTGGAACATGGGGCTCGAGCCAGACCTCAGGGTCTCCCTGCGTGTAGCCCCCAACCCCAAGCCTGATC
CCCACCGGAGACCTGAACAGCCTTGGACATCATCGGATCAGGGTGGGAGGTGCCAGCCTCTGCCACCTGACTTCCAG
TCCCTGTGCCCCTCCCACCCTGCCCTTGGGCACTCCTGCCCTGCAGGTTCCTCAGAGGGGCAACCCAAAGCCAGAGA
GGGGCGGGTCTTGTCGGGCCTCCAGCCTGGACTTCCCAGCCCCTCTGGGGCAGCATCTGGGTGCCAGACCTCGGTTC
CTAGGGCCTCGTTTCTCCCTCTGGGAACAGCCAAATGGTGGTCCCTGAGACTCAGGACAGACCAAGAAGAAGCCGGA
TGACATGGCAAGCCACACACTGCGTCCCCTGAGCAGGACGGACAGCCCGACTCCATCCTCCCACCTGCGACTGAGC
CCCCACCCCTACTCCTGTCCCAGCCGTGCCCCTGGTGACATTTGGGTGGGAGGGGAGGGGATGAGGGGCACCTGGG
GGTCAGAGAACAAATGACGGGTGAATACATGTGTGTGGCCAGGTGGAGGAGGGAGGGGAGGAGCAGGTGGGCTGGAC
AGGGCCGGTGTGAGGAAGGGGCTCAGGCTGGCAGGGGGAGGTGGCAAGAGGGATGGGCTGCCATTGGTGGTCTGAGA
CAAAGGCGGAGGGAGGAGGCGAGCGCTGATGGGAAAGGAACAAAGAGGGAAGGGGGGCGTGAAGGGGGTTCCGGCGG
GAGGGCCGAGCCGAGGGAGGAGGCGCCGGCCAGCTGGACAGAGGGAGGAGGCCAGGCCAGAGCCAGAAGACGGCCAG
AGGCACAAAGAAGCCAGCGCGCTGGCGGAGTCAAGGGATGGGGCAGAGACTGCCGGGGCCAGCAGGGACCAGCTGAA
GGCTGCGCAGGGGGTGCGGGCCACACAGGTAGCCACCCTGAGCTCAGCCACCGATGGAGGGTCGTGGGGCTGCTGCG
GTGATGGCGGTGGGCTTGGGTCCATCTGTCCTGCCGTTTCTGCACAGCTTAGGTGTCACCCACTGGCCTTCGTGGTG
TTTTCATTGTCCATCGGCAGGGACAGCTGGTGGTCTGTCTGCCCCGCCTGTCTGGCTGTCAGCCTCTGGGCAGGCTT
GCTTTTATGGGGGAGGGTCCTGTCTGTCTGTCTGTCGCCCTCTCTGGCTGTGAGCCTGGGGGTGCTGGGCTGGCCAG
TCGGCTTGCTGGGTTAGGCTGTCCCAGCTGTCTGAGTGTTTGTCCGGCTGTCAGGATGTGTCCTGGGGGCTGGGAAG
GAGAGGCCGACCCATXGTCTGTCGGTCGACTGGTCAGTTGGACGTTCAGCTGTCTGTACGTCTGTCTGCTGGCCCAT
CTGTCTCCCCTTGGGGCCACCTCTCACTCCACCTGCCCCTCTGCGCCCCGGATTGCCTGGCCAGCACCACGTGGGCC
TGTACTTGTCCACACCAGTGACTCCTGCCTGAGACCCCCCCCCAACCCAGGATCAGGCAGGACGGCTGGGGCTTAGG
TCAGGGGCCGTCTGTCCGGAAGGCATCACCGCGCCCTCCCCAGACCATCAGCTGAACCCTCTGACCCTGTGATCCCA
GACGCTGCAGGAGCTGAAG<u>ATG</u>GCGAGCTCCGTGGCGCCCTACGAGCAGCTGGTGAGGCAGGTGGAGGCCTTGAAGG
CTGAGAACAGCCACCTGAGGCAGGAGCTAAGGGACAACTCCAGCCACCTGTCCAAGCTGGAGACAGAGACGTCGGGC
ATGAAGGAGGTCCTGAAGCACCTACAGGGAAAACTGGAGCAGGAGGCCCGAGTGCTGGTGTCCTCGGGGCAGACGGA
GGTGCTGGAGCAGCTGAAGGCCCTACAGATGGACATCACCAGCCTGTACAACCTCAAGTTCCAGCCGCCCACCCTGG
GCCCGGAGCCTGCCGCCCGGACCCCCGAGGGCAGCCCAGTACACGGCTCCGGGCCCTCCAAGGACAGCTTTGGGGAG
CTGAGCCGGGCCACCATCCGGCTGCTGGAGGAACTGGACCGGGAACGGTGTTTCCTGCTGAATGAGATTGAGAAGGA
GGAGAAGGAGAAGCTCTGGTACTACTCTCAGCTGCAGGGCCTGTCCAAGCGCCTGGACGAGCTGCCGCACGTGGAGA
CGCAGTTCTCGATGCAGATGGACCTGATCCGGCAGCAGCTTGAGTTCGAGGCCCAGCACATCCGCTCGCTGATGGAG
GAGCGCTTCGGCACCTCGGACGAGATGGTGCAGCGGGCACAGATCCGCGCCTCGCGCCTGGAGCAGATTGACAAGGA
GCTGCTGGAGGCGCAGGACCGAGTGCAGCAGACGGAGCCCCAGGCCTTGCTGGCGGTGAAGTCGGTGCCGGTGGACG
AGGACCCCGAGACAGAGGTCCCCACACACCCTGAGGATGGCACCCCTCAGCCGGGCAACAGCAAGGTGGAGGTGGTC
TTCTGGCTGTTGTCCATGTTGGCGACGCGCGACCAGGAGGATACAGCGCGCACGCTGCTGGCCATGTCCAGCTCGCC
CGAGAGCTGCGTGGCCATGCGCCGCTCGGGCTGTCTGCCTCTGCTGCTGCAAATCCTCCACGGCACCGAGGCCGCGG
CCGGGGGTCGCGCCGGGGCCCCAGGGGCACCGGGCGCCAAGGACGCACGCATGCGCGCCAACGCGGCGCTGCACAAC
ATCGTCTTCTCGCAGCCGGACCAGGGCCTGGCGCGCAAGGAGATGCGCGTCCTGCACGTGCTGGAGCAGATCCGGGC
CTACTGCGAGACCTGCTGGGACTGGCTGCAGGCCCGAGACGGCGGGCCCGAGGGAGGTGGCGCCGGCAGCGCCCCGA
TCCCCATCGAGCCGCAGATCTGCCAGGCCACCTGTGCTGTTATGAAGCTGTCCTTTGATGAGGAGTACCGCCGTGCC
ATGAACGAGCTAGGTGGGCTGCAGGCCGTGGCAGAGCTGCTGCAGGTTGACTATGAGATGCACAAGATGACCCGGGA
CCCGCTGAACCTGGCGCTGCGCCGCTACGCGGGCATGACCCTCACCAACCTCACCTTTGGGGACGTTGCCAACAAGG
CCACCCTGTGTGCGCGCCGCGGCTGCATGGAGGCCATCGTGGCCCAGCTGGCCTCCGACAGTGAGGAGCTCCACCAG
GTGGTGTCCAGCATCCTTCGGAACTTGTCCTGGAGGGCCGACATCAACAGCAAGAAGGTGCTGAGGGAGGCGGGCAG
CGTGACTGCCCTGGTGCAGTGTGTCCTGCGGGCCACCAAGGAGTCCACCCTGAAGAGCGTGCTGAGCGCCCTGTGGA
ATCTGTCTGCACACAGCACAGAGAACAAGGCGGCCATCTGCCAGGTGGATGGCGCCCTGGGCTTCCTGGTGAGCACC
CTGACCTACAAGTGTCAGAGCAACTCGCTGGCCATCATCGAGAGCGGCGGCGGCATCCTCCGCAATGTGTCCAGCCT
CGTCGCCACCCGTGAGGACTACAGGCAGGTGCTCCGGGATCACAACTGTCTGCAGACGCTGCTGCAGCATCTGACTT
CGCACAGCCTGACCATCGTGAGCAACGCGTGCGGCACGCTCTGGAACCTGTCGGCCCGCAGCGCCCGTGACCAGGAG
CTGCTGTGGGACCTGGGCGCCGTGGGCATGCTGCGTAATCTGGTGCACTCCAAGCACAAGATGATCGCCATGGGCAG
CGCCGCCGCCCTGCGCAACCTGCTGGCCCATCGGCCCGCCAAGCACCAGGCGGCCGCCACCGCCGTGTCCCCAGGCA
GCTGCGTGCCCAGCCTGTACGTGCGCAAGCAGCGGGCGCTGGAGGCCGAGCTGGACGCACGGCACCTCGCGCAGGCG
CTGGAGCACCTGGAGAAGCAGGGCCCGCCGGCAGCCGAGGCCGCCACTAAGAAGCCGCTGCCGCCCCTGCGACACCT
GGACGGCCTGGCCCAAGACTATGCTTCCGATTCGGGCTGCTTTGACGACGACGATGCACCGTCATCCCTGGCTGCGG
CCGCGGCCACCGGGGAGCCAGCCAGCCCTGCCGCGCTGTCCCTCTTCCTGGGCAGCCCCTTCCTGCAGGGGCAGGCG
CTGGCTCGCACCCCGCCCACCCGCCGAGGCGGCAAGGAGGCAGAGAAGGACACCAGTGGGGAGGCAGCCGTGGCGGC
CAAGGCCAAGGCCAAGCTGGCGCTTGCAGTGGCGCGCATCGACCAGCTGGTGGAGGACATCTCCGCCCTGCACACCT
CGTCCGACGATAGCTTCAGCCTCAGCTCTGGAGACCCGGGACAGGAGGCGCCACGGGAGGGCCGCGCCCAGTCCTGC
TCGCCATGCCGCGGCCCGGAGGGCGGGCGGCGAGAGGCAGGAAGCCGGGCGCACCCGCTGCTGCGGCTCAAGGCGGC
CCACGCCAGCCTCTCCAACGACAGCCTCAACAGCGGCAGTGCCAGCGACGGGTACTGCCCACGCGAACATATGCTGC
CCTGCCCGCTGGCCGCACTGGCTTCGCGCCGCGAGGACCCCAGGTGTGGGCAGCCTCGGCCCAGCCGGCTTGACCTT
GACCTGCCCGGCTGCCAGGCCGAGCCCCCGGCCCGCGAGGCCACCTCCGCCGACGCCCGCGTGCGCACCATCAAGCT
GTCGCCTACCTATCAGCACGTGCCACTGCTTGAGGGTGCCTCAAGGGCGGGTGCAGAGCCCCTCGCGGGGCCTGGAA

FIGURE 14B

TCTCTCCAGGGGCCCGGAAGCAGGCCTGGCTGCCGGCAGACCACCTGAGCAAGGTTCCCGAGAAGCTGGCGGCTGCC
CCGCTGTCTGTGGCCAGCAAGGCACTGCAGAAACTGGCGGCGCAAGAGGGGCCACTCTCGCTGTCCCGATGCAGCTC
CCTTTCCTCGCTGTCCTCGGCCGGCCGCCCAGGCCCCAGCGAGGGTGGTGACCTGGATGACAGTGACTCCTCCCTGG
AGGGGCTGGAGGAGGCCGGCCCCAGCGAGGCTGAGCTGGACAGCACGTGGCGGGCGCCCGGGGCCACCTCGCTGCCC
GTAGCCATTCCGGCTCCCCGGCGTAACCGAGGCCGGGGCCTGGGGGTGGAAGACGCCACGCCGTCCAGCTCGTCGGA
GAACTACGTGCAGGAGACACCGCTTGTGCTGAGCCGCTGCAGCTCTGTGAGCTCGCTGGGCAGCTTCGAGAGCCCGT
CCATCGCCAGCTCCATCCCCAGTGAACCTTGCAGCGGGCAGGGCAGCGGCACCATCAGCCCTAGCGAGCTGCCCGAC
AGCCCCGGACAGACCATGCCTCCCAGCCGGAGCAAGACGCCACCGCTGGCGCCCGCGCCACAGGGTCCCCCCGAGGC
CACCCAGTTCAGCCTGCAGTGGGAGAGCTACGTGAAGCGCTTCCTGGACATCGCCGACTGCCGGGAGCGCTGCCGGC
TGCCATCTGAGCTGGACGCAGGCAGCGTGCGCTTTACCGTGGAGAAGCCAGACGAGAACTTCTCGTGCGCCTCCAGC
CTCAGCGCGCTGGCCTTGCACGAGCACTACGTGCAGCAGGACGTGGAGCTGCGGCTGCTGCCCTCGGCCTGCCCCGA
GCGCGGCGGGGGCGCCGGGGGCGCCGGCCTCCATTTTGCAGGGCACCGGCGGCGGGAGGAGGGGCCGGCGCCCACGG
GTTCTCGCCCTCGCGGCGCCGCGGACCAGGAGCTGGAACTGCTGCGGGAGTGCCTGGGAGCCGCCGTGCCTGCCCGG
CTGCGCAAGGTGGCCTCCGCGCTGGTGCCAGGTCGCCGCGCACTCCCCGTGCCCGTCTACATGTTGGTGCCCGCCCC
GGCCCCGGCCCAGGAGGACGACTCCTGCACTGACTCCGCGGAGGGCACGCCGGTCAACTTCTCTAGCGCCGCCTCGC
TCAGCGACGAGACGCTGCAGGGACCCCCCAGGGACCAGCCCGGGGGACCAGCGGGCAGGCAAAGACCCACCGGCCGC
CCCACCTCTGCCAGACAGGCCATGGGGCACCGGCACAAGGCGGGAGGCGCCGGCCGCAGCGCGGAGCAGTCTCGGGG
CGCGGGCAAGAACCGAGCAGGGCTGGAGCTGCCCCTGGGCCGGCCCCCGAGCGCCCCCGCAGACAAGGACGGCTCAA
AGCCCGGCCGGACCCGCGGGGACGGGGCGCTCCAGTCGCTGTGCCTCACGACGCCCACTGAGGAGGCCGTGTACTGC
TTCTACGGCAACGACTCGGACGAGGAGCCCCCGGCGGCCGCGCCCACGCCAACCCACCGGCGCACATCGGCCATCCC
TCGCGCTTTTACGCGGGAGCGTCCGCAGGGCCGGAAGGAGGCCCCTGCCCCGTCCAAGGCTGCACCAGCTGCCCCGC
CGCCCGCCCGGACCCAGCCCAGCCTCATTGCTGACGAGACCCCGCCCTGCTACTCCCTGAGCTCCTCCGCCAGCTCC
CTCAGCGAGCCCGAGCCCTCGGAGCCGCCGGCCGTCCATCCACGAGGCCGGGAGCCCGCGGTCACCAAGGACCCGGG
CCCAGGAGGCGGACGCGACAGCTCGCCCAGCCCGCGGGCCGCGGAGGAGCTTCTGCAGCGGTGCATCAGCTCGGCCC
TGCCCAGGCGCCGGCCCCCCGTGTCTGGCCTGCGGCGCCGCAAGCCCCGAGCCACCCGGCTGGATGAGCGGCCCGCA
GAGGGGTCCCGGGAACGCGGCGAGGAGGCAGCGGGCTCGGACCGGGCCTCCGACCTGGATAGCGTGGAGTGGCGCGC
CATCCAGGAGGGCGCCAATTCAATTGTCACGTGGCTGCACCAGGCAGCAGCTGCCACGCGGGAGGCCTCGTCCGAGT
CCGACTCCATCCTGTCCTTCGTATCCGGGCTGTCAGTGGGATCCACCCTACAGCCCCCCAAGCACAGGAAGGGACGA
CAGGCGGAGGGAGAAATGGGCAGTGCCCGGCGGCCAGAGAAAAGGGGCGCAGCCTCAGTCAAGACCAGCGGGAGCCC
CCGTTCCCCTGCAGGCCCCGAGAAGCCACGTGGCACACAGAAGACCACGCCCGGGGTGCCAGCTGTGCTCCGGGGAC
GAACAGTGATCTACGTCCCCAGCCCGGCACCCCGTGCCCAGCCCAAAGGGACCCCCGGCCCCCGCGCCACACCGCGG
AAGGTGGCGCCCCCTTGCCTGGCACAGCCCGCGGCTCCAGCCAAAGTCCCGAGCCCCGGGCAGCAGCGGTCGCGGAG
CCTACACCGGCCTGCCAAGACCTCGGAGCTGGCGACGCTGAGCCAGCCCCCCAGAAGCGCCACACCGCCCGCCCGCC
TCGCCAAGACCCCCTCCTCCAGCTCCTCCCAGACCTCGCCCGCCTCCCAGCCCCTGCCCAGAAAGCGCCCCCCGGTC
ACCCAGGCTGCTGGGGCCCTGCCCGGCCCCGGAGCCTCCCCGGTGCCCAAAACGCCGGCGCGCACCCTTCTGGCGAA
GCAGCACAAGACGCAGAGATCGCCCGTGCGGATCCCGTTCATGCAGAGGCCGGCCCGGCGTGGGCCGCCACCGCTGG
CTCGGGCAGTCCCGGAGCCGGGCCCCAGGGGCCGGGCGGGGACCGAGGCGGGCCCGGGGGCGCGCGGGGGCCGCCTG
GGCCTGGTGCGTGTGGCCTCAGCCCTCTCCAGCGGCAGCGAGTCCTCCGACCGCTCGGGCTTCCGGCGACAGCTAAC
CTTCATCAAGGAGTCGCCGGGCTTGCGGCGCCGCCGCTCCGAGCTGTCCTCGGCCGAGTCCGCGGCCTCTGCCCCCC
AGGGCGCCTCGCCCCGCCGCGGCCGGCCCGCGCTGCCCGCCGTCTTCCTCTGCTCCTCGCGCTGCGAAGAGCTCCGA
GCGGCACCCCGGCAGGGCCCGGCCCCGGCCCGGCAGCGGCCCCCCGCGGCCCGACCCAGCCCTGGCGAGCGCCCTGC
CCGGCGCACCACCTCCGAGAGCCCGTCCCGCCTGCCTGTGCGCGCGCCCGCCGCCCGGCCGGAGACTGTCAAGCGCT
ACGCGTCGCTGCCGCACATCAGCGTGGCCCGCAGGCCCGACGGCGCCGTCCCCGCGGCCCCTGCCTCAGCCGACGCC
GCGCGCCGCAGCAGCGACGGGGAGCCCCGGCCGCTCCCCAGGGTGGCCGCGCCGGGCACGACCTGGCGGCGCATCCG
AGATGAGGACGTGCCCCACATCCTGCGCAGCACGCTTCCCGCCACGGCCCTGCCACTGCGGGGCTCCACGCCCGAGG
ACGCCCCGGCCGGGCCCCCGCCGCGCAAGACCAGCGACGCCGTGGTCCAGACCGAGGAGGTCGCCGCCCCCAAGACC
AACTCCAGCACGTCCCCGAGCCTGGAGACCAGGGAGCCCCCCGGGGCCCCCGCCGGCGGCCAGCTCTCCCTCCTCGG
CAGCGACGTGGACGGTCCCAGCCTCGCCAAGGCTCCCATCTCCGCACCCTTCGTGCACGAGGGCCTGGGGGTCGCCG
TGGGGGGCTTCCCCGCCAGCCGGCACGGCTCCCCCAGCCGCTCGGCCCGAGTACCCCCCTTCAACTATGTGCCCAGC
CCCATGGTGGTCGCAGCCACCACCGACTCGGCCGCGGAGAAAGCCCCGGCCACTGCCTCCGCCACCCTCCTGGAATA
GTGGCCTAGGCCGGCCTTCTGGAACGTTCTCTCCCGGCCCTGCGGCGCGGTCTGGCTGCCCCATGGGCCTGCGCTGT
AGACGTCCCCCATAGGTCGCCCCAGGGCCTCTGCCCACCCGAGCCCCACCACTCTCAGAACCCCCGCCCAGCGCACG
GCGACCTCGCGCCTCACCGGAAGACCTTGCCTCTGTGCCGCGGAGGTCCAGGAGGAAACGGGGCGGCCGCTAGGCCT
CAAGTCCCGACCGTGGAGCGCTGGCAAGGGCGTCCTGGCCCAGCCCTGAGCGCGCGGCCCTTCCCCTGTCGGAAGCC
GTTGCTTGACCCCGGGCGAGGGAGGCGGTAGCCTCCGGGTCCGGGTCTGGGTCTGGGTCCGCTGCTTCGCAGGGACA
GCGCTGGGGAGGTGACGGCGCCCGCCGCAGGTGGGGCGAGGCTGGGGGAGGGCGGCGCCGCGGCGGGCCTGCCAGCT
GGGGGCCTTTGCGGCGCGCAGGGGCGAAGCCTGTAATCACTGCAGCCGCCGGTAATTCGCTAATGAGGGCTTTGCAG
GGATTGTTTTCATTCTCAGCCCCAGCTGTGGGAGTGCGGGTGGGGGTGTGGCCGAGCCCCGGCAGGAAGCCCCGCCC
AGACGGTGTTCAGGGAACCCGGAGCCCAAGCGCTCCGGCGGAGCCCAAAAGGGTGGGGGTGGGAGGGGCAGAGGCCA
ACGGATCCCCCTGCCTGTCGCACCCCTTGGCGGGAGACGGGAAGGCAGCGGGCTGCGTACGATGGGACCTGGTGCAG
ACGCCGGGCCGGCTGACATTTGGACCCCATCCCAGAGGAGATGCTGGCTACCAGCTGGGGCGACCCCAAGGGTCGCT
GGAGTCAGTATCGGCCCGGCGCAGCCGCGGCGGGCGAGGCCAATGGAAAGGAGACTGAGGGGAGTCCCGGCAGTGAG
CCCGAGGCCCTGGACCTGGAGCCCGCGCTGGCCTCTCCCCAGCGGAGCCTGCACGTTACGGAGACCATCACATGTG

FIGURE 14C

GGCGTGGTCAGTGCCCAGGACCGCACCGCTGCTCATCTTGTCCCTTTTCAATTCCCTTCTGGTTCATGATGCATAAA
GCGCTAGGCCCTAGAACTCCAGAAACAGCACAGCTGGGGCGGGGACCCAGCCTTGCCCTCCACCCGAGGCTCTGGGA
CAAGGCGGGAGGTTCGGGGGCCTTCCGGCAGGTGAACGCAGGGCTGGAGAGTATTTGGTGCCAGATGAGGTGAAAGC
TTATAGAAGGGCCTGAGGGGCTCGGCTGCCTCATCCCCTGGCGGGGGAGGCTGGGAGCTGGGCCTCCTGCGTGGGGT
GGGACTCGCAGGGGCCGGGTCTCCGTGACTGGGGCAACGCCTCGTCCTGCAGAGGGAGCCGACAACCTCTTTTCTGC
AGAAAAGCTCCAGCAGGCGCTGCCTTCACCCACGGATCTGCCCAGGCTGAAGGCACACGCTCAATGCCCCACGTGCC
TTCTCCAGGAGGAACGAACCAGGGTTTGAGGGTTGGGTGGATGGAGCTCAAAAGGAAACCCCAGCCCCACCACGGAT
GACCCATCCCTCCCGTCCCATCCCCAGCATGGGCAAGGCCAGCCTTTCTGGCAAAAGGAGCTGTCCTCAACTCAGGG
CCGCTGTGAGCAAAGCTGACCCCAGCCCCCACCCCCAGTTAACACTGCTGCTTCTCTGAATGCATGTCACCCTGCAC
CCCATGCTCCGGGCCCACACCCTGCAGGACAAGGAGCTCCAGACAGGACGTCCATAAGTCACCGAGGTGTGCCACCC
AGCAGGTGCTGGAGGTGCCCAATGCTCCCTCCTAGGACCTCGCAGCCAGGCAAGGCTGTCAGGTTGTTTTGGGGGAA
AAGGGGGTCATGGATGGCTGAACAAAAAGCGGGGAAAATGCAGGCTGAGTGGGGCGACCTCCTGCCTGCCAGGAGCC
CCCTTTCAGGACACAGCGGGGGTCTCACACTTGCTGTCCCCATCCATGGCCCGAGGGGGAACCTGGTGGTCTCTTCT
GAGCTTTTGGACTTGGGGATGCCAAACACGTGCTCACCCTCACACTCGCCCCGGCCCGCTGCGCCCCTAATTGCCAA
AGGGTAGGGAAATGGCGAAGCCAGCCACCAGGTCGCTGGTGACAGGGCCAGGGTTATGCAGGAAGGTGGTGCGGCAT
TGCCTTCCACATATGTAAGTCTCTGGGCGGCGCCCTCCCAGCTCCCTGCCTCTGTTTCCCCATGTGGGCCGTGGGGA
ACTCCCAGAGCTACCTCTTGGGGGAGCGTGGTGGCAGCGATGATGGGGAGACGCCTGGAAGCTCACAGAACTTGGGT
CTGGCTGGCTCCTGCCCGTGACGCCTTGCCCAGCAGCAAGGTGCGCAACATGGCTGCCAGCCCCGCCTCCCACCCCC
ACCCCGAGTCCTGAGCTCACTTTCGCCTTCTCCATCCCCTGCCGTGGGGGCCACAGCCACACCTCACCGCCCAGTCC
AGCTGTGCTCCAGAAGGGGACAGGCAGTCCGCGGTCTCTGGACAATCAACTCAAGGTACGCCCACTGCAAGGCCTCC
CTCCCACCGCGGCCCCTGCCTGGCCACCTGGCCTCTCTGCACCAGGGTGACAAGGGGTCCTCGTCTGCCCCCCAATG
CTCCAGGGCCAGTCCTAAGGAGCTGAGGGTCTGAGGACGCAGGGAGGGTGGAGGTGTCCTGAGGCTGATGGACAGTG
ACCGCCACTGGCCCCCAACATGACCACACGTGGGTGCTGAACTCGGGGCGCCGTGCCCACCGGCATGGTCCTCCCGA
GCTCCGACAGCATTACCTCACCCGGCCCCATCTGTTGCCCCGGTCCAGCCCTGATGGCGCGCGCCTGGTCTGTCTGA
TTCCCCTAGCCGCCACCCCACGTTTCTGTACCGGGTTTCTGCAGTGTTAAACGGACGTGTAAATAGTGGTAAATAGT
GAAAGCCTGTCCTTCCCTAAATGTAAAGCCATCTGTCCGGCGTAAGGACGACACCGTCAGCTGTCCGACTCGCACAC
ATTTAATAAACTGAGCTCTTGC

FIGURE 15

GTGGGCATCCACGGGCGCCGAGCCTCCGTCCGTGTCTCTATCCCTCCCGGGCCTTTGTCAGCGCGCCCGCTGGGAGC
GGGGCCGAGAGCGCCGGTTCCAGTCAGACAGCCCCGCAGGTCAGCGGCCGGGCCGAGGGCGCCAGAGGGGGCCATGT
CGTACCAGGGCAAGAAGAGCATCCCGCACATCACGAGTGACCGACTCCTCATCAAAGGTGGACGGATCATCAACGAT
GACCAATCCCTTTATGCTGACGTCTACCTGGAGGATGGACTTATCAAACAAATAGGAGAGAACTTAATCGTTCCTGG
TGGAGTGAAGACCATTGAAGCCAACGGGCGGATGGTTATTCCCGGAGGTATTGATGTCAACACGTACCTGCAGAAGC
CCTCCCAGGGGATGACTGCGGCTGATGACTTCTTCCAAGGGACCAGGGCGGCACTGGTGGGCGGGACCACGATGATC
ATTGACCATGTTGTTCCTGAACCTGGGTCCAGCCTACTGACCTCTTTCGAGAAGTGGCACGAAGCAGCTGACACCAA
ATCCTGCTGTGATTACTCCCTCCACGTGGACATCACAAGCTGGTACGATGGCGTTCGGGAGGAGCTGGAGGTGCTGG
TGCAGGACAAAGGCGTCAATTCCTTCCAAGTCTACATGGCCTATAAGGATGTCTACCAAATGTCCGACAGCCAGCTC
TATGAAGCCTTTACCTTCCTTAAGGGCCTGGGAGCTGTGATCTTGGTCCATGCAGAAAATGGAGATTTGATAGCTCA
GGAACAAAAGCGGATCCTGGAGATGGGCATCACGGGTCCCGAGGGCCATGCCCTGAGCAGACCTGAAGAGCTGGAGG
CCGAGGCGGTGTTCCGGGCCATCACCATTGCGGGCCGGATCAACTGCCCTGTGTACATCACCAAGGTCATGAGCAAG
AGTGCAGCCGACATCATCGCTCTGGCCAGGAAGAAAGGGCCCCTAGTTTTTGGAGAGCCCATTGCCGCCAGCCTGGG
GACCGATGGCACCCATTACTGGAGCAAGAACTGGGCCAAGGCTGCGGCGTTCGTGACTTCCCCTCCCCTGAGCCCGG
ACCCTACCACGCCCGACTACTTGACCTCCCTACTGGCCTGTGGGGACTTGCAGGTCACAGGCAGCGGCCACTGTCCC
TACAGCACTGCCCAGAAGGCGGTGGGCAAGGACAACTTTACCCTGATCCCCGAGGGTGTCAACGGGATAGAGGAGCG
GATGACCGTCGTCTGGGACAAGGCGGTGGCTACTGGCAAAATGGATGAGAACCAGTTTGTCGCTGTCACCAGCACCA
ATGCAGCCAAGATCTTTAACCTGTACCCAAGGAAAGGGCGGATTGCCGTGGGCTCGGATGCCGACGTGGTCATCTGG
GACCCCGACAAGTTGAAGACCATAACAGCCAAAAGTCACAAGTCGGCGGTGGAGTACAACATCTTCGAGGGTATGGA
GTGCCACGGCTCCCCACTAGTGGTCATCAGCCAGGGCAAGATCGTCTTTGAAGACGGAAACATCAACGTCAACAAGG
GCATGGGCCGCTTCATTCCGCGGAAGGCGTTCCCGGAGCACCTGTACCAGCGCGTCAAAATCAGGAATAAGGTTTTT
GGATTGCAAGGGGTTTCCAGGGGCATGTATGACGGTCCTGTGTACGAGGTACCAGCTACACCCAAATATGCAACTCC
CGCTCCTTCAGCCAAATCTTCGCCTTCTAAACACCAGCCCCCACCCATCAGAAACCTCCACCAGTCCAACTTCAGCT
TATCAGGTGCCCAGATAGATGACAACAATCCCAGGCGCACCGGCCACCGCATCGTGGCGCCCCCTGGTGGCCGCTCC
AACATCACCAGCCTCGGTTGAACGTGGATGCGCGGAGGAGCTAGCCTGAAGGATTCTGGGAATCATGTCCATCCCTT
TTCCTGTCAGTGTTTTTGAAACCCACAGTTTTAGTTGGTGCTGATGGAGGGAGGGGGAAGTCGAAGGATGCTCTTTC
CCTTTTCTGTTTAGGAAGAAGTGGTACTAGTGTGGTGTGTTTGCTTGGAAATTCCTTGCCCCACAGTTGTGTTCATG
CTGAATCCACCTCGGAGCATGGTGTTTTCATTCCCCCTTCCTAGTGAACCACAGGTTTTAGCATTGTCTTGTTCTGT
CCCTTCCACTTCTAACTCCACTGGCTCCATGATTCTCTGAGTGGTGGTTCCTTTGCACCCTGTAGATGTTCTAGGAT
AGTTGATGCATGTTACTAAATTACGTATGCAAGTCTGTGAGTGCGTCTGAGGGGACATCGCCAAGGACTGACTGAGA
CACGATGCCGAGACCTCAAGCCCTGAGGGGCAGTCCCAAAACCCTTACAGTGAAGATGTTTACTCATTGCCCCCACC
TCTGGTCCACACTAGAAAGAAGCTCGCCCCACCTCCACCTGTGAGATCCGTGAATTCTCGGAATGGCAGGGGAAGCC
TTGCACTAGGTTGCAGAGAAGCATCCTCCACATCCTGTGTCAGAAACCCTGGTCTCCGTGGCACTTGTAACTCACCG
TGCTGTCTTCTGGTCTGTGTGTGTTCTTCAAGCCAGCTCTAGGCTTCAGGCCGAGCCAGGTTCACACTCAGAAAGAT
GTCTCCCCATCCCCATTCGGGGCTGACGATGGGGGGCTGATGGCTGCCCCTGCGTGGCCTGAGTCCTGGTCCCTCTG
AGGCAGTTGACGGGGCAGTCAGATTTTTAAAGTTTTGTACAAAGTTTTCCTTTGTAATCACTCCCATTTTTACTTAA
CAACCAACTTGTTGTGGCTCTTATTTCTGAATTCAAAGCTTGTGAAAAAATAAAAGAAAATGAACTGCCC

FIGURE 16

CTCCTCACAGAAGCCTGGAGCTGGGCATCCAAGAAGAAGCAGCCTCATTTGTTTTCTGGTGTCATCGTAGGTGGCCA
CCTATGGCTTTTGGGAATGTAAAAAGGGCAGCTCTCTGGCATGTTCCTGACTGAGGATCTCATAACATTTAACTTGA
GGAACTTCCTCCTTTTCCAGCTTTGGGAGTCAAGCTTCTCACCTGGGGCGGGTGGGTTCTGCACCACCCTCCCACCC
TCCTTCCTCCGTGTGGACGATAGAGCCACATCCAGCACCACGGACAGCTCCCGGGCGCCTTCATCTCCTCGTCCTCC
AGGCAGCACAAGCCATTGTGGAATCTCCACCAGGTGTACAGAACGGTGCCTCTGCGTCCTGCCACTCAGGACCTCTC
AAGTCCCCGATGTGATGGCTCCTCAGCATGATCAGGAGAAATTCCATGATCTTGCTTATTCCTGTCTTGGGAAGTCC
TTCTCCATGTCTAACCAAGATCTATATGGCTATAGCACCAGCTCTTTGGCTCTTGGCTTGGCATGGCTAAGTTGGGA
GACCAAAAAGAAGAATGTACTTCATCTGGTTGGGCTGGATTCCCTCTGATAAGCCTTCCCAGTTGACTGAAAGATGA
GGCTAGGCTCTAGCAAGTTGAAGTCAAACCAGCTCCTTCAAGAAGCTTTGAGCAGAATGAAGTGGGGAGGACCCAGC
TTCCAGCCCAGGAAGCCCACTGTACCTGGAGCCATCTGGGATAAGACTTTGACCCATGACTCCCATATCCACAGCCT
GTCCATCCTAGCCCATCCCAGTTTATCCTGTATCATTTGAGCTGGGATTCCCACATCCTCTGAGTTGGAAGTCCCAT
CTCAAGTCTTCAATAAAGACTCTTGAATATTG

FIGURE 17

GCGAGAAGCCCCACTGAAGCCGGGCGCAGGGTCTGGGACGCAGTTGGGAGTGCAAAGGGCTGGCTGAGAGCCGCAGG
AGCAGCAGGCTGTGGCCCAGGCCTCCTGGGTGACAGGCCCTGTCTGGCGGGGAACAGGGACCAAGAGACAACACAGA
AGAGGCTGGACCTCGAACAGGGGCGGCTGCCTCACTCCCTACCTGAGCCAGCCGAGGGGGCCAAGGACTTTAGAGCT
GTTTCCTCCGGCATAAGAGAGACACTTGCTTTCCAGGGCAGCACCCTTTATCGGAGAAGGCTCTACAGGGAAGGGGT
CTTTGCAGCCTGGATGGCCATCCCACATTCCTTTAACGGAGGTCTCTAGGCCTCAGAGAGAACCCAGAGTTAGAAAG
GAGGCCAGACGGTCCTTGCTGTCCCCCTGGGGAGAGAGGAAGTTGCCGCCTGCTGCCAGGCCCAGGAGGAGCTGGGC
CTGCAATAGTGGGGGACCTGGCCCCTGAGGCAGTGGCGGCCATGTCACGGCCAGGCCACGGTGGGCTGATGCCTGTG
AATGGTCTGGGCTTCCCACCGCAGAACGTGGCCCGGGTGGTGGTGTGGGAGTGTCTGAATGAGCACAGCCGCTGGCG
GCCCTACACGGCCACCGTGTGCCACCACATTGAGAACGTGCTGAAGGAGGACGCTCGCGGTTCCGTGGTCCTGGGGC
AGGTGGACGCCCAGCTTGTGCCCTACATCATCGACCTGCAGTCCATGCACCAGTTTCGCCAGGACACAGGCACCATG
CGGCCCGTGCGGCGCAACTTCTACGACCCGTCGTCGGCGCCGGGCAAGGGCATCGTGTGGGAGTGGGAGAACGACGG
CGGCGCATGGACGGCCTACGATATGGACATCTGCATCACCATCCAGAACGCCTACGAGAAGCAGCACCCGTGGCTCG
ACCTCTCATCGCTAGGCTTCTGCTACCTCATCTACTTCAACAGCATGTCGCAGATGAACCGCCAGACGCGCCGGCGC
CGCCGTCTGCGCCGCCGCCTGGACCTCGCCTACCCGCTCACCGTGGGCTCCATCCCTAAGTCGCAGTCGTGGCCCGT
GGGTGCCAGCTCGGGCCAGCCCTGCTCCTGCCAGCAGTGCCTGCTGGTCAACAGCACGCGCGCCGTCTCCAACGTCA
TCCTGGCCTCGCAGCGTCGTAAGGTGCCCCCCGCGCCCCCGCTGCCGCCGCCGCCGCCACCTGGAGGGCCTCCAGGC
GCGCTTGCCGTGCGCCCCAGCGCCACCTTCACAGGCGCCGCGCTCTGGGCAGCGCCCGCCGCCGGCCCCGCCGAGCC
CGCGCCGCCTCCCGGGGCGCCCCCACGGAGCCCGGGCGCCCCCGGCGGAGCGCGCACCCCGGGGCAGAACAACCTCA
ACCGGCCCGGGCCCCAGCGCACCACCAGCGTGAGCGCGCGCCTCCATCCCGCCGGGGGTCCCCGCACTCCCGGTG
AAGAACTTGAATGGTACTGGGCCGGTCCATCCGGCCCTGGCAGGGATGACCGGGATACTGCTGTGCGCGGCCGGGCT
GCCCGTGTGCCTGACGCGGGCCCCCAAGCCCATCCTGCACCCGCCGCCCGTGAGCAAGAGCGACGTGAAGCCCGTGC
CTGGCGTGCCCGGGGTGTGCCGCAAGACCAAGAAGAAGCACCTTAAAAAGAGTAAGAATCCCGAGGATGTGGTTCGA
AGATACATGCAGAAGGTGAAAAACCCACCTGATGAGGACTGCACCATCTGCATGGAGCGACTGGTCACAGCATCAGG
CTACGAGGGCGTGCTTCGGCACAAGGGCGTGCGGCCTGAGCTCGTGGGCCGCCTGGGCCGCTGTGGCCACATGTACC
ACCTGCTGTGCCTCGTGGCCATGTACTCCAATGGCAACAAGGATGGCAGCCTGCAGTGCCCCACCTGCAAGGCCATC
TACGGGGAGAAGACGGGTACGCAGCCGCCTGGGAAGATGGAGTTCCACCTCATCCCCCACTCGCTGCCCGGCTTCCC
TGATACCCAGACCATCCGCATCGTCTATGACATCCCCACAGGCATCCAGGGCCCTGAGCACCCCAACCCCGGGAAGA
AGTTCACCGCAAGAGGATTCCCTCGCCACTGCTATCTACCCAACAACGAGAAAGGCCGGAAGGTGCTGCGGCTGCTC
ATCACGGCCTGGGAGAGAAGACTCATCTTCACTATCGGCACGTCCAACACCACGGGCGAGTCGGACACCGTGGTGTG
GAACGAGATCCACCACAAGACCGAGTTTGGATCCAACCTCACGGGACACGGCTACCCGGACGCTAGCTACCTAGACA
ACGTGCTGGCTGAGCTCACAGCCCAGGGCGTATCCGAGGCTGCAGGCAAGGCTTGAGG

FIGURE 18

GAATTCGAGGATCCGGGTACCATGGCGCGTGAACGCAGCTCGGCTGCCGCTGGCAGGAAACAATTCTGCAAAAATAA
TCATACTCAGCCTGGCAATTGTCTGCCCCTAGGTCTGTCGCTCAGCCGCCGTCCACACTCGCTGCAGGGGGGGGGC
ACAGAATTTACCGCGGCAAGAACATCCCTCCCAGCCAGCAGATTACAATGCTGCAAACTAAGGATCTCATCTGGACT
TTGTTTTTCCTGGGAACTGCAGTTTCTCTGCAGGTGGATATTGTTCCCAGCCAGGGGGAGATCAGCGTTGGAGAGTC
CAAATTCTTCTTATGCCAAGTGGCAGGAGATGCCAAAGATAAAGACATCTCCTGGTTCTCCCCCAATGGAGAAAAGC
TCACCCCAAACCAGCAGCGGATCTCAGTGGTGTGGAATGATGATTCCTCCTCCACCCTCACCATCTATAACGCCAAC
ATCGACGACGCCGGCATTTACAAGTGTGTGGTTACAGGCGAGGATGGCAGTGAGTCAGAGGCCACCGTCAACGTGAA
GATCTTTCAGAAGCTCATGTTCAAGAATGCGCCAACCCCACAGGAGTTCCGGGAGGGGGAAGATGCCGTGATTGTGT
GTGATGTGGTCAGCTCCCTCCCACCAACCATCATCTGGAAACACAAAGGCCGAGATGTCATCCTGAAAAAAGATGTC
CGATTCATAGTCCTGTCCAACAACTACCTGCAGATCCGGGGCATCAAGAAAACAGATGAGGGCACTTATCGCTGTGA
GGGCAGAATCCTGGCACGGGGGGAGATCAACTTCAAGGACATTCAGGTCATTGTGAATGTGCCACCTACCATCCAGG
CCAGGCAGAATATTGTGAATGCCACCGCCAACCTCGGCCAGTCCGTCACCCTGGTGTGCGATGCCGAAGGCTTCCCA
GAGCCCACCATGAGCTGGACAAAGGATGGGGAACAGATAGAGCAAGAGGAAGACGATGAGAAGTACATCTTCAGCGA
CGATAGTTCCCAGCTGACCATCAAAAAGGTGGATAAGAACGACGAGGCTGAGTACATCTGCATTGCTGAGAACAAGG
CTGGCGAGCAGGATGCGACCATCCACCTCAAAGTCTTTGCAAAACCCAAAATCACATATGTAGAGAACCAGACTGCC
ATGGAATTAGAGGAGCAGGTCACTCTTACCTGTGAAGCCTCCGGAGACCCCATTCCCTCCATCACCTGGAGGACTTC
TACCCGGAACATCAGCAGCGAAGAAAAGACTCTGGATGGGCACATGGTGGTGCGTAGCCATGCCCGTGTGTCGTCGC
TGACCCTGAAGAGCATCCAGTACACTGATGCCGGAGAGTACATCTGCACCGCCAGCAACACCATCGGCCAGGACTCC
CAGTCCATGTACCTTGAAGTGCAATATGCCCCAAAGCTACAGGGCCCTGTGGCTGTGTACACTTGGGAGGGGAACCA
GGTGAACATCACCTGCGAGGTATTTGCCTATCCCAGTGCCACGATCTCATGGTTTCGGGATGGCCAGCTGCTGCCAA
GCTCCAATTACAGCAATATCAAGATCTACAACACCCCCTCTGCCAGCTATCTGGAGGTGACCCCAGACTCTGAGAAT
GATTTTGGGAACTACAACTGTACTGCAGTGAACCGCATTGGGCAGGAGTCCTTGGAATTCATCCTTGTTCAAGCAGA
CACCCCCTCTTCACCATCCATCGACCAGGTGGAGCCATACTCCAGCACAGCCCAGGTGCAGTTTGATGAACCAGAGG
CCACAGGTGGGGTGCCCATCCTCAAATACAAAGCTGAGTGGAGAGCAGTTGGTGAAGAAGTATGGCATTCCAAGTGG
TATGATGCCAAGGAAGCCAGCATGGAGGGCATCGTCACCATCGTGGGCCTGAAGCCCGAAACAACGTACGCCGTAAG
GCTGGCGGCGCTCAATGGCAAAGGGCTGGGTGAGATCAGCGCGGCCTCCGAGTTCAAGACGCAGCCAGTCCAAGGGG
AACCCAGTGCACCTAAGCTCGAAGGGCAGATGGGAGAGGATGGAAACTCTATTAAAGTGAACCTGATCAAGCAGGAT
GACGGCGGCTCCCCCATCAGACACTATCTGGTCAGGTACCGAGCGCTCTCCTCCGAGTGGAAACCAGAGATCAGGCT
CCCGTCTGGCAGTGACCACGTCATGCTGAAGTCCCTGGACTGGAATGCTGAGTATGAGGTCTACGTGGTGGCTGAGA
ACCAGCAAGGAAAATCCAAGGCGGCTCATTTTGTGTTCAGGACCTCGGCCCAGCCCACAGCCATCCCAGCCAACGGC
AGCCCCACCTCAGGCCTGAGCACCGGGGCCATCGTGGGCATCCTCATCGTCATCTTCGTCCTGCTCCTGGTGGTTGT
GGACATCACCTGCTACTTCCTGAACAAGTGTGGCCTGTTCATGTGCATTGCGGTCAACCTGTGTGGAAAAGCCGGGC
CCGGGGCCAAGGGCAAGGACATGGAGGAGGGCAAGGCCGCCTTCTCGAAAGATGAGTCCAAGGAGCCCATCGTGGAG
GTTCGAACGGAGGAGGAGAGGACCCCAAACCATGATGGAGGGAAACACACAGAGCCCAACGAGACCACGCCACTGAC
GGAGCCCGAGAAGGGCCCCGTAGAAGCAAAGCCAGAGTGCCAGGAGACAGAAACGAAGCCAGCGCCAGCCGAAGTCA
AGACGGTCCCCAATGACGCCACACAGACAAAGGAGAACGAGAGCAAAGCATGATGGGTGAAGAGAACCGAGCAAAGA
TCAAAATAAAAAGTGACACAGCAGCTTCACCAGAGCATTTCCAACACCACAGACACACACACGCACACACACACACA
ATTCTAGGCTAGTTTCTGGTCTTATCATTGAGTTACAGCTTAGTGATGATTTTAAGACAAAACAAACAAACAAAAAA
AAAAAAAAACCATGGTACCCGGATCCTCGAATTC

FIGURE 19

CTGCCCCTGGGTCTCTGCGCCTTTGCATGAGACTTTACGGTAAGCCGCTCCTCCCGCGCCCCCGCCCCCAGCCCCGC
TCGGCGATCCCCGGCGCCGTCGCCAGGCGCTGGCCGTGGTGCTGATTCTGTCAGGCGCTGGCGGCGGCAGCGGCGGT
GACGGCTGCGGCCCCGCTCCCTCTACCCGGCCGGACCCGGCTCTGCCCCCGCGCCCAAGCCCCACCAAGCCCCCCGC
CCTCCCGCCGCGGTCCCAGCCCAGGGCGCGGCCGCAACCAGCACC<u>ATG</u>CGCCCGGTAGCCCTGCTGCTCCTGCCCTC
GCTGCTGGCGCTCCTGGCTCACGGACTCTCTTTAGAGGCCCCAACCGTGGGGAAAGGACAAGCCCCAGGCATCGAGG
AGACAGATGGCGAGCTGACAGCAGCCCCCACACCTGAGCAGCCAGAACGAGGCGTCCACTTTGTCACAACAGCCCCC
ACCTTGAAGCTGCTCAACCACCACCCGCTGCTTGAGGAATTCCTACACGAGGGGCTGGAAAAGGGAGATGAGGAGCT
GAGGCCAGCACTGTCCTTTCAGCCTGACCCACCTGCACCCTTCACCCCAAGTCCCCTTCCCCGCCTGGCCAACCAGG
ACAGCCGCCCTGTCTTTACCAGCCCCACTCCAGCCATGGCTGCGGTACCCACTCAGCCCCAGTCCAAGGAGGGACCC
TGGAGTCCGGATCCGGAGTCAGAGTCCCCTATGCTTCGAATCACAGCTCCCCTACCTCCAGGGCCCAGCATGGCAGT
GCCCACCCTAGGCCCAGGGGAGATAGCCAGCACTACACCCCCCAGCAGAGCCTGGACACCAACCCAAGAGGGTCCTG
GAGACATGGGAAGGCCGTGGGTTGCAGAGGTTGTGTCCCAGGGCGCAGGGATCGGGATCCAGGGGACCATCACCTCC
TCCACAGCTTCAGGAGATGATGAGGAGACCACCACTACCACCACCATCATCACCACCACCATCACCACAGTCCAGAC
ACCAGGCCCTTGTAGCTGGAATTTCTCAGGCCCAGAGGGCTCTCTGGACTCCCCTACAGACCTCAGCTCCCCCACTG
ATGTTGGCCTGGACTGCTTCTTCTACATCTCTGTCTACCCTGGCTATGGCGTGGAAATCAAGGTCAAGAATATCAGC
CTCCGGGAAGGGGAGACAGTGACTGTGGAAGGCCTGGGGGGGCCTGACCCACTGCCCCTGGCCAACCAGTCTTTCCT
GCTGCGGGGCCAAGTCATCCGCAGCCCCACCCACCAAGCGGCCCTGAGGTTCCAGAGCCTCCCGCCACCGGCTGGCC
CTGGCACCTTCCATTTCCATTACCAAGCCTATCTCCTGAGCTGCCACTTTCCCCGTCGTCCAGCTTATGGAGATGTG
ACTGTCACCAGCCTCCACCCAGGGGGTAGTGCCCGCTTCCATTGTGCCACTGGCTACCAGCTGAAGGGCGCCAGGCA
TCTCACCTGTCTCAATGCCACCCAGCCCTTCTGGGATTCAAAGGAGCCCGTCTGCATCGGTGAGTGCCCAGGGGTGA
TCCGCAATGCCACCACCGGCCGCATCGTCTCTCCAGGCTTCCCGGGCAACTACAGCAACAACCTCACCTGTCACTGG
CTGCTTGAGGCTCCTGAGGGCCAGCGGCTACACCTGCACTTTGAGAAGGTTTCCCTGGCAGAGGATGATGACAGGCT
CATCATTCGCAATGGGGACAACGTGGAGGCCCCACCAGTGTATGATTCCTATGAGGTGGAATACCTGCCCATTGAGG
GCCTGCTCAGCTCTGGCAAACACTTCTTTGTTGAGCTCAGTACTGACAGCAGCGGGGCAGCTGCAGGCATGGCCCTG
CGCTATGAGGCCTTCCAGCAGGGCCATTGCTATGAGCCCTTTGTCAAATACGGTAACTTCAGCAGCAGCACACCCAC
CTACCCTGTGGGTACCACTGTGGAGTTCAGCTGCGACCCTGGCTACACCCTGGAGCAGGGCTCCATCATCATCGAGT
GTGTTGACCCCCACGACCCCCAGTGGAATGAGACAGAGCCAGCCTGCCGAGCCGTGTGCAGCGGGGAGATCACAGAC
TCGGCTGGCGTGGTACTCTCTCCCAACTGGCCAGAGCCCTACGGTCGTGGGCAGGATTGTATCTGGGGTGTGCATGT
GGAAGAGGACAAGCGCATCATGCTGGACATCCGAGTGCTGCGCATAGGCCCTGGTGATGTGCTTACCTTCTATGATG
GGGATGACCTGACGGCCCGGGTTCTGGGCCAGTACTCAGGGCCCCGTAGCCACTTCAAGCTCTTTACCTCCATGGCT
GATGTCACCATTCAGTTCCAGTCGGACCCCGGGACCTCAGTGCTGGGCTACCAGCAGGGCTTCGTCATCCACTTCTT
TGAGGTGCCCCGCAATGACACATGTCCGGAGCTGCCTGAGATCCCCAATGGCTGGAAGAGCCCATCGCAGCCTGAGC
TAGTGCACGGCACCGTGGTCACTTACCAGTGCTACCCTGGCTACCAGGTAGTGGGATCCAGTGTCCTCATGTGCCAG
TGGGACCTAACTTGGAGTGAGGACCTGCCCTCATGCCAGAGGGTGACTTCCTGCCACGATCCTGGAGATGTGGAGCA
CAGCCGACGCCTCATATCCAGCCCCAAGTTTCCCGTGGGGGCCACCGTGCAATATATCTGTGACCAGGGTTTTGTGC
TGATGGGCAGCTCCATCCTCACCTGCCATGATCGCCAGGCTGGCAGCCCCAAGTGGAGTGACCGGGCCCCTAAATGT
CTCCTGGAACAGCTCAAGCCATGCCATGGTCTCAGTGCCCCTGAGAATGGTGCCCGAAGTCCTGAGAAGCAGCTACA
CCCAGCAGGGGCCACCATCCACTTCTCGTGTGCCCCTGGCTATGTGCTGAAGGGCCAGGCCAGCATCAAGTGTGTGC
CTGGGCACCCCTCGCATTGGAGTGACCCCCCACCCATCTGTAGGGCTGCCTCTCTGGATGGTTCTACAACAGTCGCA
GCCTGGATGGTTGCCAAGGCACCTGCTGCCTCCAGCACCCTGGATGCTGCCCACATTGCAGCTGCCATCTTCTTGCC
ACTGGTGGCGATGGTGTTGTTGGTAGGAGGTGTATACTTCTACTTCTCCAGGCTCCAGGGAAAAAGCTCCCTGCAGC
TGCCCCGCCCCCGCCCCCGCCCCTACAACCGCATTACCATAGAGTCAGCGTTTGACAATCCAACTTACGAGACTGGA
TCTCTTTCCTTTGCAGGAGACGAGAGAATA<u>TGA</u>AGTCTCCATCTAGGTGGGGGCAGTCTAGGGAAGTCAACTCAGAC
TTGCACCACAGTCCAGCAGCAAGGCTCCTTGCTTCCTGCTGTCCCTCCACCTCCTGTATATACCACCTAGGAGGAGA
TGCCACCAAGCCCTCAAGAAGTTGTGCCCTTCCCCGCCTGCGATGCCCACCATGGCCTATTTTCTTGGTGTCATTGC
CCACTTGGGGCCCTTCATTGGGCCCATGTCAGGGGGCATCTACCTGTGGGAAGAACATAGCTGGAGCACAAGCATCA
ACAGCCGGCATCCTGAGCCTCCTCATGCCCTGGACCAGCCTGGAACACACTAGCAGAGCAGGAGTACCTTTCTCCAC
ATGACCACCATCCCGCCCTGGCATGGCAACCTGCAGCAGGATTAACTTGACCATGGTGGGAACTGCACCAGGGTACT
CCTCACAGCGCCATCACCAATGGCCAAAACTCCTCTCAACGGTGACCTCTGGGTAGTCCTGGCATGCCAACATCAGC
CTCTTGGGAGGTCTCTAGTTCTCTAAAGTTCTGGACAGTTCTGCCTCCTGCCCTGTCCCAGTGGAGGCAGTAATTCT
AGGAGATCCTAAGGGGTTCAGGGGGACCCTACCCCCACCTCAGGTTGGGCTTCCCTGGGCACTCATGCTCCACACCA
AAGCAGGACACGCCATTTTCCACTGACCACCCTATACCCTGAGGAAAGGGAGACTTTCCTCCGATGTTTATTTAGCT
GTTGCAAACATCTTCACCCTAATAGTCCCTCCTCCAATTCCAGCCACTTGTCAGGCTCTCCTCTTGACCACTGTGTT
ATGGGATAAGGGGAGGGGGTGGGCATATTCTGGAGAGGAGCAGAGGTCCAAGGACCCAGGAATTTGGCATGGAACAG
GTGGTAGGAGAGCCCCAGGGAGACGCCCAGGAGCTGGCTGAAAGCCACTTTGTACATGTAATGTATTATATGGGGTC
TGGGCTCCAGCCAGAGAACAATCTTTTATTTCTGTTGTTTCCTTATTAAAATGGTGTTTTTGGAAAAAAA

FIGURE 20

CTCCGGTCCCCGCCGCTCCCCGTCCCCGCTGCTCCTAGCCCCTGCCGCGTCCCCGGCGGAGCGGGCATGGCGCCACC
CGCGGCGCCTGGCCGGGACCGTGTGGGCCGTGAGGATGAGGACGGCTGGGAGACGCGAGGGGACCGCAAGGCCCGGA
AGCCCCTGGTGGAGAAGAAGCGGCGCGCGCGGATCAACGAGAGCCTGCAGGAGCTGCGGCTGCTGCTGGCGGGCGCC
GAGGCCAAGCTGGAGAACGCCGAAGTGCTGGAGCTGACGGTGCGGCGGGTCCAGGGTGTGCTGCGGGGCCGGGCGCG
CGAGCGCGAGCAGCTGCAGGCGGAAGCGAGCGAGCGCTTCGCTGCCGGCTACATCCAGTGCATGCACGAGGTGCACA
CGTTCGTGTCCACGTGCCAGGCCATCGACGCTACCGTCGCTGCCGAGCTCCTGAACCATCTGCTCGAGTCCATGCCG
CTGCGTGAGGGCAGCAGCTTCCAGGATCTGCTGGGGGACGCCCTGGCGGGGCCACCTAGAGCCCCTGGACGGAGTGG
CTGGCCTGCGGGGGGCGCTCCGGGATCCCCAATACCCAGCCCCCCGGGTCCTGGGGACGACCTGTGCTCCGACCTGG
AGGAGGCCCCTGAGGCTGAACTGAGTCAGGCTCCTGCTGAGGGGCCCGACTTGGTGCCCGCAGCCCTGGGCAGCCTG
ACCACAGCCCAAATTGCCCGGAGTGTCTGGAGGCCTTGGTGACCAATGCCAGCCAGAGTCCTGCGGGGGTGGGCCCG
GCCCTCCCTGGATCTCCTCCCTCCTCCCAGGGGTTCAGATGTGGTGGGGTAGGGCCCTGGAAGTCTCCCAGGTCTTC
CCTCCCTCCTCTGATGGATGGCTTGCAGGGCAGCCCCTGGTAACCAGCCCAGTCAGGCCCCAGCCCCGTTTCTTAAG
AAACTTTTAGGGACCCTGCAGCTCTGGAGTGGGTGGAGGGAGGGAGCTACGGGCAGGAGGAAGAATTTTGTAGAGCT
GCCAGCGCTCTCCCAGGTTCACCCACCCAGGCTTCACCAGCCCTGTGCGGGCTCTGGGGGCAGAGGTGGCAGAAATG
GTGCTGGGCACTAGTGTTCCAGGCAGCCCTGGGCTAAACAAAAGCTTGAACTTGCCACTTCAGCGGGGAGATGAGAG
GCAGGTGCACTGAGCTGCACTGCCCAGAGCTGTGATGCTCTGTACATCTTGTTTGTAGCACACTTGAGTTTGTGTAT
TCCATTGACATCAAATGTGACAATTTTACTAAATAAAGAATTTTGGAGTTAGTT

FIGURE 21

CCCGAGACCCGGCGCAAGAGAGCGCAGCCTTAGTAGGAGAGGAACGCGAGACGCGGCAGAGCGCGTTCAGCACTGAC
TTTTGCTGCTGCTTCTGCTTTTTTTTTTCTTAGAAACAAGAAGGCGCCAGCGGCAGCCTCACACGCGAGCGCCACGC
GAGGCTCCCGAAGCCAACCCGCGAAGGGAGGAGGGGAGGGAGGAGGAGGCGGCGTGCAGGGAGGAGAAAAAGCATTT
TCACCTTTTTTGCTCCCACTCTAAGAAGTCTCCCGGGGATTTTGTATATATTTTTTAACTTCCGTCAGGGCTCCCGC
TTCATATTTCCTTTTCTTTCCCTCTCTGTTCCTGCACCCAAGTTCTCTCTGTGTCCCCCTCGCGGCCCCGCACCTC
GCGTCCCGGATCGCTCTGATTCCGCGACTCCTTGGCCGCCGCTGCGC<u>ATG</u>GAAAGCTCTGCCAAGATGGAGAGCGGC
GGCGCCGGCCAGCAGCCCCAGCCGCAGCCCCAGCAGCCCTTCCTGCCGCCCGCAGCCTGTTTCTTTGCCACGGCCGC
AGCCGCGGCGGCCGCAGCCGCCGCAGCGGCAGCGCAGAGCGCGCAGCAGCAGCAGCAGCAGCAGCAGCAGCAGCAGC
AGCAGCAGGCGCCGCAGCTGAGACCGGCGGCCGACGGCCAGCCCTCAGGGGGCGGTCACAAGTCAGCGCCCAAGCAA
GTCAAGCGACAGCGCTCGTCTTCGCCCGAACTGATGCGCTGCAAACGCCGGCTCAACTTCAGCGGCTTTGGCTACAG
CCTGCCGCAGCAGCAGCCGGCCGCCGTGGCGCGCCGCAACGAGCGCGAGCGCAACCGCGTCAAGTTGGTCAACCTGG
GCTTTGCCACCCTTCGGGAGCACGTCCCCAACGGCGCGGCCAACAAGAAGATGAGTAAGGTGGAGACACTGCGCTCG
GCGGTCGAGTACATCCGCGCGCTGCAGCAGCTGCTGGACGAGCATGACGCGGTGAGCGCCGCCTTCCAGGCAGGCGT
CCTGTCGCCCACCATCTCCCCCAACTACTCCAACGACTTGAACTCCATGGCCGGCTCGCCGGTCTCATCCTACTCGT
CGGACGAGGGCTCTTACGACCCGCTCAGCCCCGAGGAGCAGGAGCTTCTCGACTTCACCAACTGGTTC<u>TGA</u>GGGGCT
CGGCCTGGTCAGGCCCTGGTGCGAATGGACTTTGGAAGCAGGGTGATCGCACAACCTGCATCTTTAGTGCTTTCTTG
TCAGTGGCGTTGGGAGGGGGAGAAAAGGAAAAGAAAAAAAAAGAAGAAGAAGAAAAGAGAAGAAGAAAAAAACG
AAAACAGTCAACCAACCCCATCGCCAACTAAGCGAGGCATGCCTGAGAGACATGGCTTTCAGAAAACGGGAAGCGCT
CAGAACAGTATCTTTGCACTCCAATCATTCACGGAGATATGAAGAGCAACTGGGACCTGAGTCAATGCGCAAAATGC
AGCTTGTGTGCAAAAGCAGTGGGCTCCTGGCAGAAGGGAGCAGCACACGCGTTATAGTAACTCCCATCACCTCTAAC
ACGCACAGCTGAAAGTTCTTGCTCGGGTCCCTTCACCTCCCCGCCCTTTCTTAGAGTGCAGTTCTTAGCCCTCTAGA
AACGAGTTGGTGTCTTTC

FIGURE 22A

CTTATTTTTTATGAATGTCGGATAGCTGCACCAGCTTGGTGGGGAAAGGGTTTGATGAATAGCACAAAGACACTGGC
TGTTCCCTGGAGGCTGTCCCTTTAAAGGAGAATCTTAGTTTATTCTGGGGGGAGGGGATGCACACATTAGAGTAGGA
AAGAGGGCTTGGAATAAAATGAAAACACTCCCCCTTCATAGTCATTGTACTGAAATGCAAAGACTGCTTCCTAAGCT
GGAGATGCTAACCTTGGGTAGCTCCTTCTGTTCTCTTCAAGGGGAATTTTGTCAGGCTATGGATTCATTTACAACTG
TTAGTCATGTGGGCATGTGTGAGGAAACAGATGCCAGTTTTAATGTATTTAGCCCGAAGTTCCAATTTGATAGGAGC
CACTGTCAGTCTCTGAGGTTCCACCAAAAT<u>ATG</u>GAACTTGATTTTGGACACTTTGACGAAAGAGATAAGACATCCAG
GAACATGCGAGGCTCCCGGATGAATGGGTTGCCTAGCCCCACTCACAGCGCCCACTGTAGCTTCTACCGAACCAGAA
CCTTGCAGGCACTGAGTAATGAGAAGAAAGCCAAGAAGGTACGTTTCTACCGCAATGGGGACCGCTACTTCAAGGGG
ATTGTGTACGCTGTGTCCTCTGACCGTTTTCGCAGCTTTGACGCCTTGCTGGCTGACCTGACGCGATCTCTGTCTGA
CAACATCAACCTGCCTCAGGGAGTGCGTTACATTTACACCATTGATGGATCCAGGAAGATCGGAAGCATGGATGAAC
TGGAGGAAGGGGAAAGCTATGTCTGTTCCTCAGACAACTTCTTTAAAAAGGTGGAGTACACCAAGAATGTCAATCCC
AACTGGTCTGTCAACGTAAAAACATCTGCCAATATGAAAGCCCCCCAGTCCTTGGCTAGCAGCAACAGTGCACAGGC
CAGGGAGAACAAGGACTTTGTGCGCCCCAAGCTGGTTACCATCATCCGCAGTGGGGTGAAGCCTCGGAAGGCTGTGC
GTGTGCTTCTGAACAAGAAGACAGCCCACTCTTTTGAGCAAGTCCTCACTGATATCACAGAAGCCATCAAACTGGAG
ACCGGGGTTGTCAAAAAACTCTACACTCTGGATGGAAAACAGGTAACTTGTCTCCATGATTTCTTTGGTGATGATGA
TGTGTTTATTGCCTGTGGTCCTGAAAAATTTCGCTATGCTCAGGATGATTTTTCTCTGGATGAAAATGAATGCCGAG
TCATGAAGGGAAACCCATCAGCCACAGCTGGCCCAAAGGCATCCCCAACACCTCAGAAGACTTCAGCCAAGAGCCCT
GGTCCTATGCGCCGAAGCAAGTCTCCAGCTGACTCAGCAAACGGAACCTCCAGCAGCCAGCTCTCTACCCCCAAGTC
TAAGCAGTCTCCCATCTCTACGCCCACCAGTCCTGGCAGCCTCCGGAAGCACAAGGACCTGTACCTGCCTCTGTCCT
TGGATGACTCGGACTCGCTTGGTGATTCCATG<u>TAA</u>AGGAGGGGAGAGTGCTCAGAGTCCAGAGTACAAATCCAAGCC
TATCATTGTAGTAGGGTACTTCTGCTCAAGTGTCCAACAGGGCTATTGGTGCTTTCAAGTTTTTATTTTGTTGTTGT
TGTTATTTTGAAAAACACATTGTAATATGTTGGGTTTATTTTCCTGTGATTTCTCCTCTGGGCCACTGATCCACAGT
TACCAATTATGAGAGATAGATTGATAACCATCCTTTGGGGCAGCATTCCAGGGATGCAAAATGTGCTAGTCCATGAC
CTTTCAATGGAAAGCTTAGGGGCCTGGGGTAAATTTGCCCCGTTTAAATTTGCCCAAACAGTTTTCCTTTTGTAGAG
GGGTGTTTAAATATACAGCAATTAAAAAGTTTGTGTGGGGAAAAAAAAAAACTCATTGGCAGATCCAAGAATGACAAA
CACAAGTGCCCCTTTTCTCTGGATCTCAAGAATGGTGGAGGACCCTGGAAGGACAGCAAGGCAGCTCCCCAGCCTCA
CTCTTCACTCCTGATTGAGGCCCGGGTTTGTTGTCCAGCACCAATTCTGGCTGTCAATGGGGAGAAATAAACCAACA
ACTTATAATTGTGACACCAGATGCTTAGGATCCTGGTGCTGGGTTAGCTAAGAGAATAGACAGAATTGGAAAATACT
GCAGACATTTCCGAAGAGTTTATAAAGCACAGTGAATTCCTGGTCAATCTCTCCACTGAGGCAATTTGGAATCAATA
AGCAATTGATAATAGTTTGGAGTAAGGGACTTCATATACCTGATTCCTCTAGAAGGCTGTCTAACATACCACATGAT
TACATGAACTGTATGGTATCCATCTATCTCTGTTCTATTGAATGCCTTGTTAACAGCCAACACTGAAAACACTGTGA
GAATTTGTTTTCAGGTCTGACACCTTTCAGTCTCTTTTTATAGCAAGAAATCAATATCCTTTTTATAAAAATTCATG
TCTGTATTTCAGGAGCAAACTCTTCAGGCTCCTTTTTTATAAACTGGTGATTTTTCTTTTGTCTAAAAAACACATGA
AGAAAATTTACCAGAAAAAAAAAAAAAAAGCCGAAGAATAATGTTATTTAGAAATTATGCTGTCACTGCCAAACAGTA
ACCTCCAGGAGAAAACAAGATGAATAGCAGAGGCCAATTCAATAGAATCAGTTTTTTGATAGCTTTTTAACAGTTAT
GCTTGCATTAATAATTTCAATGTGGACCAGACATTCTAATTATATTTTAAATGAAATGTTACAGCATATTTTAAGCA
ACTCTTTTTATCTATAATCCTAATATTTCATACTGAAGACACAGAAATCTTTCACTTGTCTTTAACATTAGAAAGGA
TTTCTCTTTACTAAGGACTGATCATTTGAAATAGTTTTCAGTCTTTTGAGATACAGGTTTATAACACTGCTTTTTTT
TTCCTGTAAACATAGCCCATAATGGCAAAAACAACTAATTTTAATTGAAGGTCTTGCTTGCCAXTCCTGTGTTGGCT
TTXACCAAATATAAAAATTCCCTTATTCCTTGGTAATGGTGCAAATXTTTGGAAAGGCACAGCATCCAAACCAAGCT
GCTGTTTGGCTACTGAATGGCTTGCAGTTGTTCCTCCACTCTAAATGGAATGAGCTTGCTGTGTGTGTGTGTGGTGG
TGGTGGGAGGGGGTGGTGCATGTGTGTGTGTGTGTGTGCATCTGCAGCTGCTTCAAAATTAAGAAATACTACAAGAC
ACCCCTGTAATGGATTGGTGGCAACTGGGTGGCACTGCTGATGTGCACTGTGTAGGGGGGAACCCAGTGGTGGTGGG
GTATCTCAAATGCCCCTAGACAAGCTTCAGATGTCTGTAGCTACCAAAAACATTTTCGGTTCAAGAAAAGTGAGATG
ATGGTAGTACTGGTTTCTGGTGAAATTGAAAAACCCCAAATGATGAGGATCTCTTTTTGCCCCCTCTCCTTTTTTTG
TAAACCCATTCAAAACCATTAATAAGCCCATTTTACTAAXCCCCTATTTCTTTCTAGAAGCTCAGGGTTTXCTTAGT
GCCTCCCAXAACATTTTGTAGTTAATTGGGAAAAAGTGATACTTGGATTAGGGGGTGTGGGCATAAAGAATGGTGGG
AGGCCTGATTTTAAAATTCAGGCCAGAACCCCCAATGACTCCACCCATAGTXCACTTTAGGTCTCATTTAGTCCAT
CACCTTTATTTTAAGTTGAGGAAGTGGAGGCTGGTAAAGAGCAGGACCAGAGGAAGAATCCAGATTTCCTTATGCTT
GGGCCTCACACTAGCTCTXTGAGTATTTCCTTGATTGCGGTATATGTACTACTAGAAAATACCAAATGGATATATTT
TCTTTAGGATAACCTTTGAACCAACAATXTTCAATAACAATAGTACATCTTCCATCTTACTTTTAATCGAGTATAAG
GAAATGTTTCTTTATGGCCATTTTGGAGGGAGCAGGGGATGAGGCTTGGCATAGTCCAAAATTTAAGXCTCCAATAA
TTAATTGCATTTTAAATTGTTTTAAATTGGCCCACTTTCAAGGCAATTTTTTTTGTGTGTCTGTAACTGAGCTCCTC
CACCCCTGTCATTCACTTCCAATTTTACCCAATCCAATTTTAGCACTCAAGTTCCATTGTGTTAATTTTTGCACGGT
CTACACACATCAAGTCAGCAAGCATTTGCCACCACTCCCTATACTTCTCCCTCTTTTTTACACACACACACACACAC
ACACACACAATCCATCTCTTGCTTGTTCCTACCTCCCTGATTTTTCTTCCCTACAGAAATAGAAATAGGGACAAAGA
AGGGGAAAATGTATATATTGGGGCTGGGCTGAACAACTAACTTCATAAGTAGTATTAACTAGGGGTAAATTGAGAGA
AAAGCTCCTTTTCTCTTCACTGTTTTGGAAAGGATAGCCATTAGCATGACTGCTTTGTGTCCTTATGGACTTTAGTA
TTAGCCTAGATTGAATTATAGCGTTTTTCTAGCTGAAGGAACCTTAAGATCACATCATCTACTCCTCTACTCCAAAT
TTCTCATTCTTCAGGCCAGGAAACCGAGACACAGAGGTAAAGTAATTTCCCCAAGGTCACACAGCTGGCTGGGGCAG
GATTGGGTTTACAACCCACATCTCCTGGCTCTTATTCCAGGGCCTTTTCCCACTAAGTAGTATTGCCTTCCATTAGG
CTCCTGAGAGTTATTTCTCAGGGTCATGTTGCATCTTGGAGCCACATGCTGCTGCCCTGATCTCAGTGGGAAATXCA

FIGURE 22B

CCCAGCAACCTAATACAGCCCCTTTTCCCTGCATTCACCTGGTTCCCATCCACATGGGTTGCAGATGTCCTTGAAGA
GAGTGAGGCATTGAGGGCCAATAGGAGCAATGGGGTCCCTGGCCTTGTCCATCTGATTCAGGAGATCACTGCTCCAT
CGTGAGGAGCCCTCTGAATAGCCCCCCACTGAATGCTTGCCTTGCCCAAATGGAATGGAGGAAGATTGATTTTCTCC
ATCAGTTCACCTTGTGTCATCTCATAATGGTTGGTCTTTCCAGGCTGAGGGAAATGTTTCTTGTTTCCAXAGTAXAA
AAAAGAAAGAGTGGAACAATAXCTTTGTTCATCCTAACTTTCTGAGATGGCTTTTCAACATTTAAAAAAAACTAGTG
TGGTACCATTCACTGGCAXGATTTXTTTTAGAATATGGAGTAAGATGAGGTAGAGAAAATAACCTGGTCTCACTGT
GGTTGCCCTCATCCACAATGTCCCCAAAGCCATCCTGCTXTGATGAGGACAATTTCCAGGTATAAGCAAGGGGCTTT
GTGACAAAAATGTACCCTGGCTGATGTTAAACATTGGCTCCTGTGTTTGCACCAAAATAGCAAGCTGTGTGCTCTAT
ACACTCTTCCCATCGTCTTGTGTACACTGCTCCTGTGGCCTTCCACAGCAGAAACCAGGGCAAAAGGGTCCAAACAC
ATGGTTTTCCTTGCTGCAAGGCTXTTCCTGGGAACTAAGGGGGTATTTATTAGTTCAGTTXTAAGAGACCTCCTTCT
GGGCTTACCCCACTCCTCAGGTACTTCTCTCTCCTTCCTCCTTCTCCTCCACAGTCACAAGTAACCAAGGAACCTGA
AAGTGGATGTGTAGCTATTTGAAGAAGGCAAGGAACCCTGAGATTCTTCTTTGAATCCTTTAGTCCAAGTCTTAGAC
CAGTGATTGGTGCTTACCTTGAACAAAATTTTGTCTGTGTTCCTAATCCCTTCAATACTXTGGGTACAATGCTCCCA
ATCACCCTGCACATTTGATTCTAAATGGCTTTTATTTTTTAAAAATCCATATCCCTAGGACAAGAXAACAGGATGCC
TATATCCCCAAAATGAGCTCCAGGACACTGATGGGAATGATCCCAAXGATCACCCCACCTCAGAAAACGTCTGTGCC
AAXAGACTTCCCCAGATAGAAXCACTGGGACAGTGGTTTGAACGACTTCTTTTATGGTTGTCCAGTTTGCTATGGAA
ATAAAAGGCATTGATTTTTTAAAAAAGATGATTGGAACCTGTCTTTGGCCACATAGGGCCACTTGGATCCATTTCCA
GGCCTTACTCATATATTGCCTTCACTGAAGGGCTTTGGCTTTAAGTCCCAGACTGGTCTCCCAAGTGAACCATAAGT
GTTTTGGAGCTCATCTGGGGTGAGGCATGAGAATGTTGCCCCATCTATCCCTTCAGGAAAAGGTGCCTTCCCTCCCT
TTCTCCTAAAGCCTGGTCCCCAAAAATTGTTTTTGTCTCCAAAAGTCTAGTATGGTCTTTATACACCCAXACTCTTA
GTGTTGCGTCCTGCCTTGTTTCCTTGTTAAGGATCTATGCAXACCTCCCGCTTTGGCTTAGCTAGCGTGACATTGGC
TATCATTTGACAAGACTAACTTTTTTTTTTTTTTTTTGACTGAGTCTCCCTCTGTCACCTAGGCTGGAGTGCAGTG
GCACAATCTTGGCTCGCTGCAACCTTCACCCTTCACCTCCCAGGTCGAAGCGATTCTCCTGCCTCAGTCTCCCGAGT
AGCTGGGATTACAGGCGTGCGCCACCAAATCTGGCTATTTTTTTATTATTATTATTTTTAGTAGAGATGGGGTTTCA
CCATGTTGGCCAGACTGGTCTTGAACTCTTGGCCTCAAATTATCTGCCCACCTCGGCCTCCCAAAGTGCTGGGATTA
CAGGCATGAGCACCATGCCCAGCTGACAAGACTAATTTTTTATCCCTTGGTTTATTGGCTTCAACATCTTCTGGAAT
CAGAGGTGATTTTTTCTTACCTTGGATGCCTGAGACTAGGGGAGTATAGAATTCCAATTGGTAATTAAGGCATCTTT
CTGCTCCTGATCAGAAGGGCAGGTTAGTTGGGAGAGGTCAGATGGCACAACAGAAGTCACCTTGTAAGTAAGGCAAA
GACTTTGAAGGCATTAGCGTTTCTCATTACTTAGGTCAATAACCTTGAGGGAATCAATGGCTTTTTTGCCGCTCTAC
CTCTTTGTGTATCTCTTTGACTTTTCTTTCTCTGTCTAGTTTCCTCTGTTCTCAGTTTATATTCTATGTTATCAGTC
TCTCTTTCCACAGTACAAACATCCATCCTTTCTCCTGTGCAATTCTGTCTCTCCCTCTTATTATCTTTATTTGTACT
TTTTCCTTCCTCCCTGTCTAGGCATTGGGCATGTGCCTCTTCTTAGCCTGTGATTTTGCCTTGGGACTGATGATAAA
TTATTTCCAGATTCAATCAGCCCTGGTCCTACCCCAGTCCAATCAGAAGTATGTTGGTGGGGAATCAACCTGATCCT
GGCCCTTTCTTCTTCTCCATTTTCATTCGTAATCCCCCTCAGCAGATCTTTACAAGCAGTTTCCTTATAGCTCATGT
ATCTTTAGGTCTTTGCCTTCCAAGCACTGTACAGAATACTTTGTGGTTCCTTTTTAGTCTGACATTTTGTGGAGCAG
TGAAGCGTGCTCAGAGACATAATCAGCTGAAGAGAAAAAATCCACCCATGGATTTATATCAGCTAAATACTAATAAT
TGATTTTGTTTGATGTGCCCATAATTTTTAAAGCTGCAATATAATATAATGAGGGACCACAGGTAATTTCTCCTGTC
ATTTGTTTTGGCTGGATGGGGGTGGGGAGTAATTGCTTAAAGTTTTACCATTACACATTAAACTCTCTATAATAAT
CTTGTTTGGGGCTTGCTAACTGTTGAGCTGTTTTAACTAAACTGGTAGGCAATCGGAGTTGATTTAAATGAAAAGAT
AATTTAACAAATCTATACTATAAAAAGAGACATTTGCTTAATTGACATGTATTTTTTTCCTTCTGAGTCACCTAAACA
TTTACTCTTGACACCAACTGTTCATGATACTGAATAGACAGTCCATATAAGAGAAATTAGTGGACCTAAAGAAGCCA
GATTGTAGGTGTTAATTTATTAAACAGAATTGCAAAGCCCTTGGAAATGTCACTGCTTGGCAATACCATATGGCATG
CCAAAATTTACAATGACTTTTCTTTATAAGTTATCCAAAAGGGATTTGAACAAGTAAGAGGTTATGCCAAAATGTCT
CCAATGTATGGTCCTGTAATATATTGCAGCTTGAAGCCAATGATCCCTTATGACTTGTATACAACTAATGCATGTTT
TATTGAATTTTGCATTTCCCACGTGTGGTAAGTCTTTAAAATGTTTTTGATCACCTTTXTGTGCCATTAAACTTGTA
CAGAAAATGTTTTTATGGCCATTTTCAAAGGGAGAAAGTTTAAAATGGAAACAGCCCACCCTTTCTGCCCTATAGCT
GTAGTTAGAATTGAGTACCTGTAGCAAAACAGCTGTAATTGGTGGTTGTAGTGTTAGAGGTGTTAGCTTGCTAGTGA
CTAGCTTTGGAGAGTAAATGCATGGTATTGTACATCACATTTCTTAACTCGTTTTAACCTCTGAAAAGAATATATTC
TTCTTTGTAGTCCTTCTTCCCACCCCCTTGCCCTCTCCCTCTCCCTGCTCCCAGTTGTCTTACAGTTGTAAATATCT
GATTTGAGGCCCAATAACTCTTGCCAAGTAAAGTCAGCAAACAACAAACAAACCAAAATGTGGGAAAAGGCATTTC
TCAACCATCTCTCAGCAGTTATTGATCATTTCTTAAGGAACAGCATTGTGATCAAAGACTCAACTTTACGTAAAAAT
CAGTGGTAAATTGGGGTTGTATTGGCCATTGATTACATTCAGGATTGAATAGTTTTCAGAATCACATGTAATCCAAA
GACAGTAGGTAGTGATGTCCCTTATCCCTGCAGCTGTTTTAAGATAGAGACCTCAGAAGACTCTGCTTGACCGATGA
CCAATAATTATTTGAAAAAAAAAGAAAAAATGAGAGAAATAAAACAGATATTTAAGAACTTTAGCCACCTATTTAGA
ATAGTTATAGCCAGAAAAAAAAACAAGGGCATGAGTTCAAATGCATTACTATCAGTGTCCTAGGCAATACCTAACCT
ACTCTGAAATTGTGATTCAAAAGCAGTATTTCAAGAGGCATTCTCCTTTTTTGGTTTGCTGACCCCACTTGGACTGG
TAGGTTTGGTGAGGCCCCCATAAACCAGCTGGAGCAGACCCTTTTCATCTCCTGTGCCTGTAACACCCCTCTTCCCC
CACCCCCTCCGCAATTCAATGAGGGCTTTCTTGGGTCAGAGGACTTCAAGGTTGTCTAGAGAAGTTTGCCATGTGTG
TAAGGTGCTGTGAACTGTGAGTGCTGAAGATTCGCAGCATTCAATACCAGGCAGCCAAAGAGCTGCTCTTGCAATTA
TTTTGGCTCTCAAGCTCTGTTCTTCATCGCATTCTCATTTCTGTGTACATTTGCAAGATGTGTGTAATGTCATTTTC
CAAAAATAAAATTTGATTTCAAT

FIGURE 23

GTTGGAGCGGCGCTGCTCGGCCGCGGACACACGAGGGACGCGCCCGAGGAGCTGCAGGTGGCAGCCCAGGCGGTCCG
AACCCGTCGGCCGGCCGAGCCTGGAGTATTGCCTAAGTGTAATCTTGAACATGGGCGGTGCTGTGAGTGCTGGTGAA
GACAATGAAGAGCTGATAGATAATTTGAAAGAAGCACAGTATATCCGGACTGAGCTGGTAGAGCAGGCTTTCAGAGC
TATCGATCGTGCAGACTATTATCTTGAAGAATTTAAAGAAAATGCTTATAAAGACTTGGCATGGAAGCATGGAAACA
TTCACCTCTCAGCCCCGTGCATCTACTCGGAGGTGATGGAAGCCCTAGATCTGCAGCCTGGACTCTCGTTTCTGAAC
CTGGGCAGTGGCACTGGGTATCTCAGCTCCATGGTGGGCCTCATTCTAGGTCCTTTTGGTGTGAACCATGGGGTGGA
ACTTCACTCAGATGTGATAGAGTATGCAAAGCAGAAACTGGACTTCTTCATCAGAACAAGTGATAGTTTTGACAAGT
TTGACTTCTGTGAACCTTCCTTTGTTACTGGGAATTGCCTGGAGATTTCTCCGGATTGTTCTCAGTATGATCGTGTA
TACTGTGGGGCTGGCGTGCAGAAAGAGCATGAAGAGTACATGAAGAATCTTCTCAAAGTGGGAGGGATCCTTGTCAT
GCCACTGGAAGAGAAGTTGACTAAGATAACACGCACAGGTCCTTCAGCTTGGGAAACCAAAAAGATTCTTGCTGTTT
CTTTTGCTCCTCTGATCCAGCCCTGCCATTCAGAGTCAGGAAAATCAAGACTTGTCCAGTTACCACCAGTGGCAGTT
CGCAGCCTCCAGGACTTGGCTCGCATCGCCATCCGGGGCACCATTAAAAAGATTATTCATCAGGAAACTGTGAGCAA
AAACGGAAACGGACTAAAGAACACCCCCAGGTTTAAACGAAGGAGAGTTCGCCGCCGTCGAATGGAAACGATTGTCT
TTTTGGACAAAGAAGTCTTTGCCAGTCGGATTTCCAACCCCTCAGATGACAACAGCTGTGAAGACTTGGAAGAGGAA
CGGAGGGAAGAAGAAGAGAAGACCCCGCCGGAAACAAAGCCAGACCCCCCAGTGAACTTCCTACGCCAGAAGGTCCT
GAGCCTCCCTCTGCCAGATCCCCTGAAATACTACTTGCTTTATTACAGAGAAAAATAAGTCTCCTGTTTGAAAGGGG
GAAATAGGAAGAGCAGATTGCTGAGTGTGAAGTTCGTGCTGCCTGTGTGCTGTTGAAGGGTCACCTGGAGGCAGACG
TTGTGGGGAAGGGAACTGCTGGGCTCATCCACACCATGGTTTTCTTCTAGTTCCTGATTGACCTCTAAAATTCTATT
CAGTTGTATGATTTGTTTACATAGTTCCACAAGACCTTCATTGCATAGAAGATTGTTTTCCCAAAGTGGAGAGAATC
TTCATAGAGAAAAAGAGAAGGCTGTTTCTTTTTCGGCTCTGACGAAACACTGAAGTCTGCGTAAGAGAGACTGTTTG
ATGACCGTCCCTCATGCAACATGCACGGTACTCACTAAAAATGAAAACTGAAGTGGAAACTAACCTGTGTTGCTTAT
AAAGTGTGAAAGCACAAGCTTATAAATGTATAAAATCTTTTCTGGGTGTGACGCACCTGCGTCCAAGTTTGAATTTT
TATGATATGTACCACTTAATTACTGGCACTGAGTATCACTGAATTTCTTAGTTTTCTAGTGGGAAACATTATTGAG
AAGCCCTCCCTTATTTTAAGTAAGTTGATTAAATCTTATGTGAGTTGCCAGTTGTAATTTTTCAAAGGAAAAATTTT
GATGGGGTGGAGGAATGAATTGCCAGATAATCTTTCTGGAATTCCGAGAGAATTCCAAAGAGGGTTTTTTTTTTTT
TTTTTTAGGACATCTTTTGATACCTTTAAAAGAACCACTGTCAAGTAATCCTTAAAAAAATATCTTGGAAAAGGAAA
CAGATTTTTTCCTGTGTGTAAGCAATAAGTGAAGTTACATTTGCCCTAACCCTAGGGATGATTCTTTACCCAGTTTT
AAAGCCCATCATGGTATTCTAAGGTGTTGACACCCTCCATCCTCAGAGCAGGTCGAAAATATTAAATAGACTGGGGA
CTCTATGATGGGCAGCCTGTGCTTTTTGACTTCAGTTTGCTATTTTTCTGTGATCACATTAGTACTGATTCATAGAT
TCTATCTTTTATAATTCTGGAGAAAAAGATTTGTTAGTTTTGTAATTTTTTTGTAAGACCAAATGTATGTATTTTAG
TAGCTCCATTGCATGAGAAGAGTGTAACTCACACTGACTTGTGATATCAGCCTTCTCTGGGCCTTGTGTGTGGAGAG
CTTTCTATCTTACCAAGTGGTAGGGCTAAAAGAACAACAGCCTTTTTGGTAGTCACATAGCAGAATGATCAGAGTTA
CATTGCTTATTCCAAAACATTGGTTCTTTTTAAAACATTTTTTTTTACCCAAAGAAAAGAATAATAGAAATTACTAA
CAATAAATATAAATTCAGAGTGTTGATATAGGATTCAGTATCCAGAGTTTATTTTTAATCTTAATCCTCAGCTTCTT
GGGAGTTGCTGGGCTTCAGTGTCTCTGTGGTTTCACCAGCTTAGCTTGAGCTCTGGTTATTTTGGATCTTTTCTGCT
TTTTTTAAGTAACTGAGTCATTTTTACCACACAGTCCAGTTTGCATGTATAGCTAGGAAACATGTATTGCTCTAGAT
TGGGCAGTTTAAGTCATTTTAAAGAAAGTTAGTTCATAGTTGTTGCCTTTTAACTCATAGTCAAGCTTCAGTCTTTC
AAAGAGAAATGTGTGATTTTCATTTACTTGCTGATATTTTGTAGTTTGGAGATCCTTGTGGGCATTATTCTAACTGA
TACGTAGACACTTACTTGGAAATTTTTGGACATTATATTAAATGAGTGCTATCTGTGAAATTGGTTATATTAGGTGG
CTTGACTAATGTTTTTTCTATAATTGTATATGGACTGCATTTTTAAAAAAACCGCATTTGCCTTTATGCTAGATTGT
AAAAAATTATATTAGAATGCATAAGACATGTTTTTCCTTCATATGCTAGACTTTTCCTAGCATTTCGTATTTCTGTG
TTGTCAGTGTGTGATTTTTAAACCGGAATTTGGTTTAAAAAAAATCTGGTGGTAATATATGTGAGAAATACTTTGGT
GTTTACCTTATGAAAATAAAGGATTGTAAGTAAAGTTTCCTGCGCACCTTATACCAGAATTCAGTATAATACACTAC
TTTCTGTTTTCAAACAGATAAATCATAATATAGTCTGTATTATCTGTAAGATCTGTCTTGTAAACCACATTCTTGAC
AACTATTTGCTTTTGAGTAGTTTGTATTTTAATATGTGACTTTTGTCTTGAAAAGTAGTAAAGCCATAGACTTGTGC
AAAACAAGTTTCAAGTTTATAGATATTAAGTTTGTAATGTGAGCATCAAATGTGTATGTAAAAATACTTTTTACCAG
TCTGGAACTTGGGAAAATCCAGGGAATTTGAAACATAGATTTTAATGAGCTGGTAAACACAAATCATGTCAATAAAG
GTAGTCAGGATATTTTATCCTTAGCATTGCTTCTGC

FIGURE 24A

GTGGCTTTGGGTCCCCAGGATTCTGGATCGTGGTTGCATCTGGAGAGAAAAAAGGATCAATCGACACGTTTTAGAAG
TGTCCGTGGGTGAATAAAAAAGGAGGGGGGGGTGCAAAACTGGGGTTGCGGATGCTTAAAGCAAAAAAAGAGAAAA
GGAAGCGTCTTGAATCCTGGAACAAGAATTACCGGGTGCTCGAGATTTCAAAAAAGCGTCTAGAAACTGGTAAATAC
TTGGACCATTTCAGCTTGAATTTGACGGCGAAGTGTTGTAGAGACCGTCTCCTTGAATCATTGCAAAGGGACCGGGG
AAAGATGAGGGGGCTCCCTCTGTGGATTTATCTTGCTGAGGGATATAGACCTGCAGCTAACTGGATTTGATTTATAA
GAGAGAAATCTGCAGTCAATGCCCACTCTTGCCACACTGCTAATATGGAAAACAGAATGTTCAATAGGATATGGTCT
GATAAATAGTGATGATTGAAGATGCTGCTCCAATACATGTGAAATCAATGGGAGATATCTGCTGTCCGAAGATCTTT
CAGAGCTTTTCTCGACAAGCTCCCCTGTAAGAAATCGGAGGTATATTCTACCATTATACAGTCTTTCTCAAGTGGAT
ATAAATACGTTTGCCTCACTGTAACCAGACAACTAGACAACTAATGTGGGACCATGGCACTGCCCAGATGCACGTGG
CCAAATTATGTTTGGAGAGCAGTGATGGCATGCTTGGTACACCGGGGATTGGGTGCCCCATTGACTCTCTGTATGTT
GGGATGTTTGCTTCAGGCTGGCCATGTGCTATCACAAAAATTGGATGATGTGGACCCACTGGTGGCTACCAACTTTG
GAAAGATAAGAGGGATTAAGAAGGAACTCAATAATGAAATTTTGGGGCCTGTTATTCAATTTCTTGGGGTTCCATAT
GCAGCCCCACCAACAGGGGAACGTCGTTTTCAGCCTCCAGAACCACCATCTCCCTGGTCAGATATCAGAAATGCCAC
TCAATTTGCTCCTGTGTGTCCCCAGAATATCATTGATGGCAGATTGCCAGAAGTCATGCTTCCTGTGTGGTTTACTA
ATAACTTGGATGTGGTTTCATCATATGTGCAAGACCAGAGCGAAGACTGCCTATATTTAAATATATATGTCCCGACT
GAGGATGATATTCGGGACAGTGGGGGTCCCAAACCAGTGATGGTGTATATCCATGGTGGCTCATATATGGAAGGTAC
TGGAAATTTATATGATGGAAGTGTCTTGGCAAGTTATGGCAATGTGATCGTCATCACAGTCAACTATCGACTTGGAG
TACTCGGTTTCTTGAGTACAGGCGATCAGGCTGCAAAGGGGAACTATGGACTCCTTGATCTCATACAAGCTTTAAGA
TGGACTAGTGAAAACATTGGATTCTTTGGTGGTGACCCCTTAAGAATCACTGTTTTTGGATCTGGTGCTGGGGGTTC
ATGTGTCAACCTGCTGACTTTATCCCATTATTCTGAAGGTAACCGTTGGAGCAATTCAACCAAAGGACTTTTTCAAC
GAGCAATAGCTCAAAGTGGAACAGCCCTTTCCAGCTGGGCTGTTAGTTTTCAACCTGCAAAATATGCTAGAATGTTG
GCCACAAAAGTTGGTTGCAATGTTTCAGATACAGTAGAGTTAGTGGAATGCCTACAGAAGAAGCCTTACAAAGAACT
TGTTGACCAAGATATTCAACCAGCTCGATACCACATAGCCTTTGGACCTGTGATTGATGGTGATGTAATACCAGACG
ACCCCCAGATATTGATGGAGCAAGGAGAGTTTCTCAACTATGATATAATGTTAGGAGTGAACCAAGGGGAAGGGTTA
AAATTTGTTGAAAATATAGTAGATAGCGATGATGGTATATCAGCTAGTGATTTTGACTTTGCTGTTTCAAATTTTGT
TGATAATTTATATGGATATCCTGAAGGCAAAGATGTTTTGAGAGAAACCATTAAGTTCATGTATACTGACTGGGCTG
ACCGTCATAACCCTGAAACCAGAAGAAAGACATTACTGGCTTTGTTTACGGACCATCAGTGGGTGGCACCAGCTGTA
GCCACAGCGGATCTTCACTCAAACTTTGGTTCACCTACGTACTTCTATGCCTTTTACCATCATTGCCAAACAGATCA
GGTTCCAGCTTGGGCTGATGCAGCCCACGGAGACGAGGTTCCCTATGTACTGGGAATCCCCATGATTGGCCCTACAG
AGTTATTTCCTTGCAATTTCTCCAAAAATGATGTGATGCTGAGTGCAGTTGTAATGACATACTGGACAAATTTTGCT
AAAACTGGTGACCCAAATCAACCAGTCCCTCAAGACACGAAATTCATTCATACCAAACCCAACCGTTTTGAAGAAGT
AGCATGGACCAGATATTCCCAGAAAGACCAACTTTATCTCCATATTGGATTAAAACCAAGAGTTAAAGAACATTACA
GAGCCAATAAGGTGAACCTCTGGTTGGAGTTGGTACCTCATCTGCATAATCTCAATGACATTTCTCAGTATACCTCT
ACAACAACTAAAGTGCCATCAACTGACATCACTTTCAGACCTACGAGAAAAAATTCTGTACCTGTCACGTCAGCCTT
TCCCACTGCCAAGCAGGATGATCCCAAACAACAACCAAGTCCATTTTCAGTGGATCAAAGGGACTACTCAACAGAGC
TGAGTGTCACTATTGCAGTTGGAGCATCACTGCTGTTTCTGAACATCTTGGCCTTTGCAGCCCTGTACTACAAAAAG
GATAAGAGGAGACATGATGTTCACAGGAGATGCAGCCCTCAGCGCACTACTACCAATGATCTAACCCATGCACAAGA
AGAGGAAATCATGTCCCTCCAAATGAAGCACACTGATTTGGATCATGAATGTGAGTCCATTCATCCACATGAGGTGG
TTCTTCGGACCGCCTGTCCCCCAGATTACACACTAGCTATGAGGAGGTCACCTGATGATGTTCCCTTAATGACACCC
AACACCATTACAATGATTCCCAACACTATACCAGGGATTCAGCCCTTACACACATTCAATACATTTACTGGAGGACA
GAACAATACTCTGCCCCATCCCCATCCCCACCCCCATTCACATTCAACAACCAGGGTATAGCCAGATAAGAGAAACA
AACTATTTTTTTTGATGGATTGCAGTAAACGATCACTGAAGATTCCTTGGCTTTCAACCTACAAGACTTACTATTTA
AATAAGGAGGAATATTATGTGAATATACATATCAAGAACTTTGGGGGTTTTGAAAAAAATGAATTGTATATATACAA
ATCAACTTTAAAAACAAATTTCAATTGCTTGAAGCAATTGTTCTGAATGATACTTTTTCATTCACATTCAAGAATTA
ATTTTTTGAAGATTTAAGTTACATAATGGAATTAGGCATGTGGAACACCAAACAGGAAAGAACTATGTCTGAAATAT
AAAAAATAAAAATAAAAAAACAACTATGAATATGCACAAGGACACACCAGTGGAATGTCAGATAATTTTCACCAGT
TTTTATTTGGAGCCGTTTTATTGTGTAGACCATATTTACATATTTGGATAAGTACACAAAGCGTCAATGCTGTTAAT
GGCCTTAGCAAAGGCTCATGCTGAAATTTGCCAGTAAAACAAAGAAGTTTAAAGACTGGCAGGTACACCATTATCAC
ATAAGTGCTGTCAGTATAAAGTTGTGGGATAAAGGAAACTGGATATTTTTAGCACGATGTGCATGATAATTTATAT
GCTTGGTGGCTGTGCTGCTGATTAAGCCGTAATTAAAATTCTTCTCATCCCATTGGAGTTTTTAATAGAAGCTTCCT
CCATCAATTGGCAGAACCTAAAGAAGATTTTAAGGGGCAAAAGTAATTACAATAAAATAATTCACAGTAGTTTCAAT
ATAGAAGGAATTAGCTATTAAAGGTATTTGAAGAAACTATAGGTATAGTGGTGAATACTCGCTGATATGAATCCCAG
AAAAAATTTCCTGTTTTTAATGTTCTTTTCAATCCCATCTAGATAATTTATAGAAATATAACCCTAATTGGACATGT
GGTAGAGGATCTATAAGTTGCTGTGTTTTTTTGTTACTCTGTATTTTGTTCCTTTTGGTAAGGTGAAGTGTGTCCAA
AGAGTTACTTGCAACAGTCTTTCATGATATGAGGATGCCCCCGTATTACCACTCTGATTATAGTTCTGAGTTCTTTG
ATTTACTCATGCTGCATGACAAAATGTTTACTAATAACAATTCATTATAAAGTTATATCCCTCTTTACATCACTTAT
CTTTCTCACTGAGGTTCATTCACTGGAATTTACTCACGCAATCTCAGTAGAGTACAACGTAGATACAGAACCTAGGA
GAGTCAACATCTGGAGGATTTTAGTCTTTCTTACACATATGTGTGATTTTAAACGAATATTCTCAGACCACAGGAAA
CTCTTCATCCCCCTGTTGTTTACCAGTAACAGTATATCACAGACCTTTCCAAATGTTTGTATATGTAATCAGATGTA
CATTTATATTGAAAAACAAATGAGATGGACTTAAAGAGCACATCCTGATAAATACTTTCTCTCTCACCTGTACTATA
TTTCTATTAGACTAAAGTTATGTGATTTTTTTTTTACATTTTTTCAGATGACTAGCAATTTTGATAGTTTATAAGAT
AATGCAAAGAACTTTCTCTGACAAACTAACTGCAGTAACAGAAACCTTTCTTTTCAGTTACTCTTTTTCAAGAATGA

FIGURE 24B

AAGATTATTATACAAAAAATTGTATACTACTTGATGGAACCAACTTTGTACATCTTGGCCATGTCACTGGTCATTGT
GTGAAATAAAGATAATCTGGATAATGACTATTAGTCCAATGCTAAGAAACATGATCTTTGCTCATTAAAGAGCTAAA
ATGTTTATTGCTGTTTTGTCTTTCTTTTTTCT

FIGURE 25

GGCACGAGGCTCGGCCATGCTACGCGCGCTGAGCCGCCTGGGCGCGGGGACCCCGTGCAGGCCCCGGGCCCCTCTGG
TGCTGCCAGCGCGCGGCCGCAAGACCCGCCACGACCCGCTGGCCAAATCCAAGATCGAGCGAGTGAACATGCCGCCC
GCGGTGGACCCTGCGGAGTTCTTCGTGCTGATGGAGCGTTACCAGCACTACCGCCAGACCGTGCGCGCCCTCAGGAT
GGAGTTCGTGTCCGAGGTGCAGAGGAAGGTGCACGAGGCCCGAGCCGGGGTTCTGGCGGAGCGCAAGGCCCTGAAGG
ACGCCGCCGAGCACCGCGAGCTGATGGCCTGGAACCAGGCGGAGAACCGGCGGCTGCACGAGCTGCGGATAGCGAGG
CTGCGGCAGGAGGAGCGGGAGCAGGAGCAGCGGCAGGCGTTGGAGCAGGCCCGCAAGGCCGAAGAGGTGCAGGCCTG
GGCGCAGCGCAAGGAGCGGGAAGTGCTGCAGCTGCAGGAAGAGGTGAAAAACTTCATCACCCGAGAGAACCTGGAGG
CACGGGTGGAAGCAGCATTGGACTCCCGGAAGAACTACAACTGGGCCATCACCAGAGAGGGGCTGGTGGTCAGGCCA
CAACGCAGGGACTCCTAGGGGCCCAGTAAGGACAGTGCCCGCCAGGGACCATGTATGTATCATGGCGGAAGAGTTGG
CCCTGACCTGGAATAAAGCAGTTGGTGTTGCTTATGAGGAAGGTTCAGCCTTATCCAGCACAGCCTTCACGTTTTGC
CCTCTGCTGTCACCACTTGGTCAGAAACTTCCAAACGCAGTGCCCTGTTCTGCCGGTGTGTACAGCCTCAGCGCACC
AGGAGACCCTAGAGTGGTTTCCATCTCACAGAGAATCAGACAGGGCCACAGCCCCCTCAGGCAGCCAGGTCATCTGA
GTATCATTAAGAGTAGTGATGGGAAGATTACAGTCTGAGGGCCAAACGTGCCTGCTTCCTGTTTTTGTAAATAAAGT
TTTGTTGGAACACAAAAAAAAAAAAAAAAAAAAAAAAA

FIGURE 26

ATGCCGGGCATGATCTGCAAGAACCCAGACCTCGAGTTTGACTCGCTACAGCCCTGCTTCTACCCGGACGAAGATGA
CTTCTACTTCGGCGGCCCCGACTCGACCCCCCCGGGGGAGGACATCTGGAAGAAGTTTGAGCTGCTGCCCACGCCCC
CGCTGTCGCCCAGCCGTGGCTTCGCGGAGCACAGCTCCGAGCCCCCGAGCTGGGTCACGGAGATGCTGCTTGAGAAC
GAGCTGTGGGGCAGCCCGGCCGAGGAGGACGCGTTCGGCCTGGGGGGACTGGGTGGCCTCACCCCCAACCCGGTCAT
CCTCCAGGACTGCATGTGGAGCGGCTTCTCCGCCCGCGAGAAGCTGGAGCGCGCCGTGAGCGAGAAGCTGCAGCACG
GCCGCGGGCCGCCAACCGCCGGTTCCACCGCCCAGTCCCCGGGAGCCGGCGCCGCCAGCCCTGCGGGTCGCGGGCAC
GGCGGGGCTGCGGGAGCCGGCCGCGCCGGGGCCGCCCTGCCCGCCGAGCTCGCCCACCCGGCCGCCGAGTGCGTGGA
TCCCGCCGTGGTCTTCCCCTTTCCCGTGAACAAGCGCGAGCCAGCGCCCGTGCCCGCAGCCCCGGCCAGTGCCCCGG
CGGCGGGCCCTGCGGTCGCCTCGGGGGCGGGTATTGCCGCCCCAGCCGGGGCCCCGGGGGTCGCCCCTCCGCGCCCA
GGCGGCCGCCAGACCAGCGGCGGCGACCACAAGGCCCTCAGTACCTCCGGAGAGGACACCCTGAGCGATTCAGATGA
TGAAGATGATGAAGAGGAAGATGAAGAGGAAGAAATCGACGTGGTCACTGTGGAGAAGCGGCGTTCCTCCTCCAACA
CCAAGGCTGTCACCACATTCACCATCACTGTGCGTCCCAAGAACGCAGCCCTGGGTCCCGGGAGGGCTCAGTCCAGC
GAGCTGATCCTCAAACGATGCCTTCCCATCCACCAGCAGCACAACTATGCCGCCCCCTCTCCCTACGTGGAGAGTGA
GGATGCACCCCCACAGAAGAAGATAAAGAGCGAGGCGTCCCCACGTCCGCTCAAGAGTGTCGTCCCCCCAAAGGCTA
AGAGCTTGAGCCCCCGAAACTCTGACTCGGAGGACAGTGAGCGTCGCAGAAACCACAACATCCTGGAGCGCCAGCGC
CGCAACGACCTTCGGTCCAGCTTTCTCACGCTCAGGGACCACGTGCCGGAGTTGGTAAAGAATGAGAAGGCCGCCAA
GGTGGTCATTTTGAAAAAGGCCACTGAGTATGTCCACTCCCTCCAGGCCGAGGAGCACCAGCTTTTGCTGGAAAAGG
AAAAATTGCAGGCAAGACAGCAGCAGTTGCTAAAGAAAATTGAACACGCTCGGACTTGCTAG

FIGURE 27

CGGGGGGATCTTGGCTGTGTGTCTGCGGATCTGTAGTGGCGGCGGCGGCGGCGGCGGGGAGGCAGCAGGCGCGG
GAGCGGGCGCAGGAGCAGGCGGCGGTGGCGGCGGCGGTTAGACATGAACGCCGCCTCGGCGCCGGCGGTGCACG
GAGAGCCCCTTCTCGCGCGCGGGCGGTTTGTGTGATTTTGCTAAA<u>ATG</u>CATCACCAACAGCGAATGGCTGCCTTAGG
GACGGACAAAGAGCTGAGTGATTTACTGGATTTCAGTGCGATGTTTTCACCTCCTGTGAGCAGTGGGAAAAATGGAC
CAACTTCTTTGGCAAGTGGACATTTTACTGGCTCAAATGTAGAAGACAGAAGTAGCTCAGGGTCCTGGGGGAATGGA
GGACATCCAAGCCCGTCCAGGAACTATGGAGATGGGACTCCCTATGACCACATGACCAGCAGGGACCTTGGGTCACA
TGACAATCTCTCTCCACCTTTTGTCAATTCCAGAATACAAAGTAAAACAGAAAGGGGCTCATACTCATCTTATGGGA
GAGAATCAAACTTACAGGGTTGCCACCAGCAGAGTCTCCTTGGAGGTGACATGGATATGGGCAACCCAGGAACCCTT
TCGCCCACCAAACCTGGTTCCCAGTACTATCAGTATTCTAGCAATAATCCCCGAAGGAGGCCTCTTCACAGTAGTGC
CATGGAGGTACAGACAAAGAAAGTTCGAAAAGTTCCTCCAGGTTTGCCATCTTCAGTCTATGCTCCATCAGCAAGCA
CTGCCGACTACAATAGGGACTCGCCAGGCTATCCTTCCTCCAAACCAGCAACCAGCACTTTCCCTAGCTCCTTCTTC
ATGCAAGATGGCCATCACAGCAGTGACCCTTGGAGCTCCTCCAGTGGGATGAATCAGCCTGGCTATGCAGGAATGTT
GGGCAACTCTTCTCATATTCCACAGTCCAGCAGCTACTGTAGCCTGCATCCACATGAACGTTTGAGCTATCCATCAC
ACTCCTCAGCAGACATCAATTCCAGTCTTCCTCCGATGTCCACTTTCCATCGTAGTGGTACAAACCATTACAGCACC
TCTTCCTGTACGCCTCCTGCCAACGGGACAGACAGTATAATGGCAAATAGAGGAAGCGGGGCAGCCGGCAGCTCCCA
GACTGGAGATGCTCTGGGGAAAGCACTTGCTTCGATCTATTCTCCAGATCACACTAACAACAGCTTTTCATCAAACC
CTTCAACTCCTGTTGGCTCTCCTCCATCTCTCTCAGCAGGCACAGCTGTTTGGTCTAGAAATGGAGGACAGGCCTCA
TCGTCTCCTAATTATGAAGGACCCTTACACTCTTTGCAAAGCCGAATTGAAGATCGTTTAGAAAGACTGGATGATGC
TATTCATGTTCTCCGGAACCATGCAGTGGGCCCATCCACAGCTATGCCTGGTGGTCATGGGGACATGCATGGAATCA
TTGGACCTTCTCATAATGGAGCCATGGGTGGTCTGGGCTCAGGGTATGGAACCGGCCTTCTTTCAGCCAACAGACAT
TCACTCATGGTGGGGACCCATCGTGAAGATGGCGTGGCCCTGAGAGGCAGCCATTCTCTTCTGCCAAACCAGGTTCC
GGTTCCACAGCTTCCTGTCCAGTCTGCGACTTCCCCTGACCTGAACCCACCCCAGGACCCTTACAGAGGCATGCCAC
CAGGACTACAGGGGCAGAGTGTCTCCTCTGGCAGCTCTGAGATCAAATCCGATGACGAGGGTGATGAGAACCTGCAA
GACACGAAATCTTCGGAGGACAAGAAATTAGATGACGACAAGAAGGATATCAAATCAATTACTAGCAATAATGACGA
TGAGGACCTGACACCAGAGCAGAAGGCAGAGCGTGAGAAGGAGCGGAGGATGGCCAACAATGCCCGAGAGCGTCTGC
GGGTCCGTGACATCAACGAGGCTTTCAAAGAGCTCGGCCGCATGGTGCAGCTCCACCTCAAGAGTGACAAGCCCCAG
ACCAAGCTCCTGATCCTCCACCAGGCGGTGGCCGTCATCCTCAGTCTGGAGCAGCAAGTCCGAGAAAGGAATCTGAA
TCCGAAAGCTGCGTGTCTGAAAAGAAGGGAGGAAGAGAAGGTGTCCTCGGAGCCTCCCCCTCTCTCCTTGGCCGGCC
CACACCCTGGAATGGGAGACGCATCGAATCACATGGGACAGATG<u>TAA</u>AAGGGTCCAAGTTGCCACATTGCTTCATTA
AAACAAGAGACCACTTCCTTAACAGCTGTATTATCTTAAACCCACATAAACACTTCTCCTTAACCCCCATTTTTGTA
ATATAAGACAAGTCTGAGTAGTTATGAATCGCAGACGCAAGAGGTTTCAGCATTCCCAATTATCAAAAAACAGAAAA
ACAAAAAAAAGAAAGAAAAAAGTGCAACTTGAGGGACGACTTTCTTTAACATATCATTCAGAATGTGCAAAGCAGTA
TGTACAGGCTGAGACACAGCCCAGAGACTGAACGGC

FIGURE 28A

AAAGGCAATTTACCAGTGATTTCTGGGTGCTGGGGCTGATATTTTTTGTGCATATTTAAGAATGTCTTCCAAGCAAG
CCACCTCTCCATTTGCCTGTGCAGCTGATGGAGAGGATGCAATGACCCAGGATTTAACCTCAAGGGAAAAGGAAGAG
GGCAGTGATCAACATGTGGCCTCCCATCTGCCTCTGCACCCCATAATGCACAACAAACCTCACTCTGAGGAGCTACC
AACACTTGTCAGTACCATTCAACAAGATGCTGACTGGGACAGCGTTCTGTCATCTCAGCAAAGAATGGAATCAGAGA
ATAATAAGTTATGTTCCCTATATTCCTTCCGAAATACCTCTACCTCACCACATAAGCCTGACGAAGGGAGTCGGGAC
CGTGAGATAATGACCAGTGTTACTTTTGGAACCCCAGAGCGCCGCAAAGGGAGTCTTGCCGATGTGGTGGACACACT
GAAACAGAAGAAGCTTGAGGAAATGACTCGGACTGAACAAGAGGATTCCTCCTGCATGGAAAAACTACTTTCAAAAG
ATTGGAAGGAAAAAATGGAAAGACTAAATACCAGTGAACTTCTTGGAGAAATTAAAGGTACACCTGAGAGCCTGGCA
GAAAAAGAACGGCAGCTCTCCACCATGATTACCCAGCTGATCAGTTTACGGGAGCAGCTACTGGCAGCGCATGATGA
ACAGAAAAAACTGGCAGCGTCACAAATTGAGAAACAACGGCAGCAAATGGACCTTGCTCGCCAACAGCAAGAACAGA
TTGCGAGACAACAGCAGCAACTTCTGCAACAGCAGCACAAAATTAATCTCCTGCAGCAACAGATCCAGGTTCAGGGT
CACATGCCTCCGCTCATGATCCCAATTTTTCCACATGACCAGCGGACTCTGGCAGCAGCTGCTGCTGCCCAACAGGG
ATTCCTCTTCCCCCCTGGAATAACATACAAACCAGGTGATAACTACCCCGTACAGTTCATTCCATCAACAATGGCAG
CTGCTGCTGCTTCTGGACTCAGCCCTTTACAGCTCCAGAAGGGTCATGCCTCCCACCCACAAATTAACCAAAGGCTA
AAGGGCCTAAGTGACCGTTTTGGCAGGAATTTGGACACCTTTGAACATGGTGGTGGCCACTCTTACAACCACAAACA
GATTGAGCAGCTCTATGCCGCTCAGCTGGCCAGCATGCAGGTGTCACCTGGAGCAAAGATGCCATCAACTCCACAGC
CACCAAACACAGCAGGGACGGTCTCACCTACTGGGATAAAAAATGAAAAGAGAGGGACCAGCCCTGTAACTCAAGTT
AAGGATGAAGCAGCAGCACAGCCTCTGAATCTCTCATCCCGACCCAAGACAGCAGAGCCTGTAAAGTCCCCAACGTC
TCCCACCCAGAACCTCTTCCCAGCCAGCAAAACCAGCCCTGTCAATCTGCCAAACAAAAGCAGCATCCCTAGCCCCA
TTGGAGGAAGCCTGGGAAGAGGATCCTCTTTAGATATCCTATCTAGTCTCAACTCCCCTGCCCTTTTTGGGGATCAG
GATACAGTGATGAAAGCCATTCAGGAGGCGCGGAAGATGCGAGAGCAGATCCAGCGGGAGCAACAGCAGCAACAGCC
ACATGGTGTTGACGGGAAACTGTCCTCCATAAATAATATGGGGCTGAACAGCTGCAGGAATGAAAAGGAAAGAACGC
GCTTTGAGAATTTGGGGCCCCAGTTAACGGGAAAGTCAAATGAAGATGGAAAACTGGGCCCAGGTGTCATCGACCTT
ACTCGGCCAGAAGATGCAGAGGGAGGTGCCACTGTGGCTGAAGCACGAGTCTACAGGGACGCCCGCGGCCGTGCCAG
CAGCGAGCCACACATTAAGCGACCAATGAATGCATTCATGGTTTGGGCAAAGGATGAGAGGAGAAAAATCCTTCAGG
CCTTCCCCGACATGCATAACTCCAACATTAGCAAAATCTTAGGATCTCGCTGGAAATCAATGTCCAACCAGGAGAAG
CAACCTTATTATGAAGAGCAGGCCCGGCTAAGCAAGATCCACTTAGAGAAGTACCCAAACTATAAATACAAACCCCG
ACCGAAACGCACCTGCATTGTTGATGGCAAAAAGCTTCGGATTGGGGAGTATAAGCAACTGATGAGGTCTCGGAGAC
AGGAGATGAGGCAGTTCTTTACTGTGGGGCAACAGCCTCAGATTCCAATCACCACAGGAACAGGTGTTGTGTATCCT
GGTGCTATCACTATGGCAACTACCACACCATCGCCTCAGATGACATCTGACTGCTCTAGCACCTCGGCCAGCCCGGA
GCCCAGCCTCCCGGTCATCCAGAGCACTTATGGTATGAAGACAGATGGCGGAAGCCTAGCTGGAAATGAAATGATCA
ATGGAGAGGATGAAATGGAAATGTATGATGACTATGAAGATGACCCCAAATCAGACTATAGCAGTGAAAATGAAGCC
CCGGAGGCTGTCAGTGCCAACTGAGGAGTTTTTGTTTGCTGAATTAAAGTACTCTGACATTTCACCCCCCTCCCCAA
CAAAGAGTTATTAAAGAGCCCGCATGCATTTGTGGCTCCACAACTACATCAGCAGAATGGTCTTAATTGTTTCGTAA
AGTGTGAGACAGATTAAGTTTTCCCTGATTTTTCATGAACTTGAGTTTTTTGTTGTTATTGTTATTGTTGTTGTTGT
TGTTTTTTTAATTTAGGTGAAGACATATTAAATATGAGACACCAGGACTTGAAACTTATCTCAACCCGTAGATGTCT
TACAAGTCTTATATTTTTGTCTTACTTTTTTTTTCTTTTGGATGTTGATAAAGGTTTAAGTTACTGTTTTAGATGGG
GTTAAACATTCTCACTCAGGTATGCTGTGCCGGCCTACAGGTTGTGAATGTGTTTTTATTCTGAATTATTTTAGAAA
ACAACTGAGGATTTCATATTGTGAAACAGAACAAGTCCACGGCGTGTGCAGCTGCATGTAGAGCATATTCAAAAGGC
CTCGGAATTCCAATTTTCCATTTGTAGAGTTAAACTTTGAATGTGCCAAACTTTTTCGTAACTTTTGAATCTTAATA
TTTTGAAAGTCTTAAAGGAGACACTGCAAAGTCTTAGACAATCTTTGGCATCTTAAAATAAAATAGCAAACCAACAT
TTTTTTTTCCAGAAAATGGTAAGGTACTCAGGAATCTGGAGACAAGATATTGTAAGGAACGAACAAGGTTGCCACAG
TGCATGGACCCAATTGTGTTTGCCTGTTGACGTGCCATCAGTGCGTGATGTGGTATGACATACACACACCAGAGCAA
CCGCCACACCAGATATCGACAGAGTGGTCTTCTCTGCCTGAGACCACCTCTCACTACATCCATTATCCCTTTGCCTT
TAACCCTGACATTCAGTCTTAACACATTTTATCTTAAATAATTTATTCATTCCAGAATGTCAAGGGTCCACTTGCTA
TTTATTTTTTTTCAATTGTTGGTGGCATTAATTTAATAATTCTTGTTTTTCACCTTCCTTCCCCGAAGAACTTTTCC
GTCCTTTTCACCTCCTTCTCCTGTGTACATAGTGATTTTATGTCCCCAGAACGCCTGGAAGCATTTCTGAAACCAAG
ATATTATTAAAAACCTATTATTGTTTTTAATCATGAGTATGTATCTGGCTGCAGGGCTGTGTATTGGATATAGGTA
TATAGTCTTACACTTAAACAGGTATGCCCCTGAGGTTCACTGTGACCTCAAGTCTTTTGCCAGAATTTTCCCCTAAT
TCAGTTCACAAGTGGTAGGGTCTGCATCAGTGGCATTTCCCCCTGAATTCCATTCAGCAGCAAGGTTCAACAGTGGT
GACTGCCAGGCAGGAGAGTCCTGCGGCCAAACCTGAAGCCCAAGGCTCGTGGGCCATGCAGGAATCTCAGTGAAGCT
GTCATGGGCTGGCACCTTTACACTGAGTTGCCTTGTCCCAGCTGGCACATCTAGGGAGTTCATTGCAAAATCCCCAG
GATGCAAAAAGCCACATGACAGCCTCAGAGCAAAGATGGTGGCAAATAGTCATGATACATCTAGAGAATGAAAGAAA
ACTGTAAGGGAGGAGAAGGAGGGGAATACATTCCCTATATGGGATGTTCCTACTGTTAACTCTGGGGAACAGATAGC
TCCGGGGGCAGCAGATGAGTTCCTCTGGCTGACTCTATCTGTAGCCACATGGGGACCTGCCTACGTGTGAACAAAAT
GAACTGCACTTATCACACAAGGATTTCTTTGAAGACATGCTACTGGGGTGGAAGCAGTGAGGTTTTATTCCCCATC
TCCTAACTACAGGGAGCTCTGCCATGTCATTTTGGCCTTCCTGAAACTAGGACAGGTTGTCTATCGGGGGGCTTCCC
CCAGAGAGGTTTAGTGGGAGAATGTCAGTGAATGGGATAGTTCACCTCATGGGACAACCCAGAATCTGATCACCAGG
ACATAGGAATGGCCCCATCAGATTTCTTGAGCCATTTTGTCACTTGGAAGAAAATAGTGTACCTTTGTATTTATTTA
AGAGTGCTCAAGGCCTAATAGCAATAAACAGGTCTAGCCAAGAAATTACAAGCTATTCTGTTAGCTGGGAGTGCTCT
CTATAAGCTGATTAAGGTACTGATAGGAACTCTTTGTTATTCATGTTGGTTGGGGATTAGAAATTTGTTTTTGTACA
TTTATTTCAAATGAGGAGGAGGTCATTTTTTCTCTCAAAAAATGAGTATTTATTATTGTCTTACTGATTTCTTTGAT

FIGURE 28B

TATATACCTCTCCTCCTCAGTTCACTCTTGTTTTTTTCTTTCTCTTTGGCTTTTGCTTTTGCTCTCTCTCACTTCT
TTCTTATTTTGTTGCATTGGTAGAGTGTTGTATGGCTAGCATTGTATTGTATGTAATTAATTTTGCACAAAAGCAAA
CATTTAGCATAGTAGGTTAATTTTGTTTGTTTTTATGACCATGCCAAAATAATATTCTGGGCTGGTGGAGAACAAAG
GACTGTTCTTTAGGACTGAAACTTGATTTTGCTCATAGTAAGTAAAAAAAAACAAAAAACACACACACTCACAGATG
TTGTTTCGTAAGTGTTATAAGCACTGGATATAAATGGTATTTTTTATCACTTCTGACTAATGTGAAACTGTTGTACG
AAAACTACATGAACAAAAGTCATCTGTTTCGACTCGTGTGGGCTTGCCTCACAGTTGCCGGATTTGAGTCATTTTTA
TGTCTTGTTATTTCATTTATTTATGCAAAATACATGTGTGTATGAACACTTTGTTTTAGCTCCAGCTCTGCCTCAGT
ACTGGGGTTCATTTACTTTTAGCCATGTTCTTAAAAATGAAAGGCTATTCAGGAATGATCTGATTGTAAACGTCTTT
TTCATTGGATCAAACAGTAATGCTGTATTTGAATCTAAATTTTGTGTATAAGCAGTTTATTTATTAGCCAAGTTTGG
CTCTAAATATCCATGGAAATTAAGAATGACAATCATAGGGATCAATTCATTTTATTTTCAGTGGGGCTTAAACAAAG
TTTATATGACTTTACCATCTCATTTTAGATTTTTCTAATTGTGTAAATATAACATAGAAATAGAATTTATTTTTGGT
TCATGAATACTTAGTGAGATATAAGTTATGTATTTCCTTTTTGTTCTCTATCCATAGATGTTGGTCCAAACTGAAAG
TTGATGAGTCACTGTGCCTCTCGGGGTAGTGAGTTATCAGCTACAGTGAGAGAGCAGTGTTTGGCCTGCAGCTGGGA
CAGCAAAACGTTTCACCAGGGTTCTCATGCAGTTCAGAACCCACTGTCCACAGATCCAGACATTTCCCTTTTTTCTT
ACAGAAAGTTGATGATTGGACATACTAAATTTCCACTACAGTTAGGAGACAGTCAGTTTGCTTTGGGAGTCTACATA
AATCTTCTAAGATAGTTCTGTGACCATTTAATAGCAAGAAGCATGAATGCCACTACAAAGGCAAAAATCCACCTCTG
AGATCGGCCGTTAATAAACGTCCCGTCATGTCAGTTTAGATTCAAGAATGTTAAGCAACTTTGTTTTTGCGGTGCTC
CCTATTTCATAGTATCTTCAAATCAAAAATAAAAATTATCTCCATTTTGTTAAAGAACTTACAGGGTCAGGGTTCTC
CTTGTCACTTAGAATTGGGACACTGCCAGGCAATCCTCTCCCAAAAAAAAAAAAAAAAAAAAATAGCCATATGGAAT
GGAAGGAAAAGGAGAAAAGAAGGAAGAAAGGAAAAAAGTAGGAAGGGAGAGAGAAAAAAAAGGTCGCTTTGCGGATA
CGAGCCGCTAGGCTGACAACTTTTCTATTTCATTGGCAGATATGAAGCAGTGTCTTTTCCAGTAAGGTACGGAAGCT
TTGTTGTTTTCATGTGTACCCAGCTCAGCCTTTTAGAAGCACCTCGGTTTGCTTCATTAGGTATTTGATACTCTCCA
GCCTTGTCCTCAGGCCTGATTTGATTTGCCAGGGTCCTGACACCAAAGCCCAGGCCAAGTTCTAAATTCAGGTGTGG
GCTCACAGTGCTATTGAGCTTGTCGAATTCTGGCCTCCCCTGAACATTAGCCCCACGGGAGCCTGAGGGTGTTTGAA
AAGGGCGTGATCACTCTAGGGCTGAAATTAAAGGCTGCTTTCTTTTCCTTCTGAAGCCAGGCTGCTTCTTCGGAGTA
CACCCTCCTGAGCCAGGAGCACAAGCACTAGCAGAAAGCAGGGATTGTTTCAGGAAAGCCCATTTACCCTCAGTAGG
AAGGCAGCCTGGTCACTTGAACAGCACAGCTGAGGCTGCTTCTCTCAATTTACTCATTTTGCAAAGAATTGACCTCT
ACCAACTCATTAGGGAGAGGAAAAAGAATCACTTAGTAATTTTAAATCATATGAGAAGTCCTGTACCAAGTGCCAAC
AACTGCAAAGAAATGCAGCTAGAGGAATGTATTGAAATTACTACTGGGTCTTCCTTTTTAATGAGAAAATGACAAAA
ATGGTTGCTGTAGCCCTGCCTGATTTTGTACACGTTTGTCTAAGAATTGAGTTGGCACTTAAGCTCACTTCTCAAAG
TATAATAATATTGTATGACCTCATTTGTCCTTTCACAAAAGCACTTGCATCATTTCCTTAAGTCATCTGCTCCCTGA
CATGTTTTCTTCCCTAATAAACAACTTCTGTCTGTTATTCCTGCCAATGATGTTCTGTTTCTGATGCCATATCCTAT
TGAGCGTGCCCCTGTACTAATATCATTGAAAATATTGATATGCAAACACATTTCCTTTTCATCCCCATTCTATCTTT
CCCTTTGGGGACAGATTGCTTTCCAAAAGCTCATGAACAAATATTTGGAATGCTGGTACCTTTGGGGCAGAGGTAAG
GGTGGGCGGGGTGGGGGCAGAAAGGTAATGCTTAATGCAGATAACTCTTCTAATCAGTGTCCATGGCAATATGAACG
CTTGAAGAAAACTCAGTGACATATCTTGCTCAGTAGTTTCTTATTCCTGAAGAACCACAAGCATAAAGTGAGGCCTC
AGTGCTGGTGCTCTTGGAGTATGGGGAATGTGCAAATATTTAACTGTTTTGTATGCTGCACATTGCAGGTCTGCTCA
TGTGCATTCTCCCTTTGTCTTCCTTTGTCATATGTGTTTTTGCTTTTTTGAAAGTGCAGTCTTTATTGTACCCTCCT
CCAGCTTGTAGCAAATTAGAATGCTTAGCATTTATGTTCATTCATTATTGTATTTGCCATGTAAAATTTTTATTACC
TTAGACAAGCTTATAAGCTGTTACTACATAACTTATCTTACTGTAACTCTTTTATTTCCCCCGACGTTGTAATTTGT
TTGTGATGTATATTGTGAAATTGTATTCTATGTTAATTTAATCAGCACAATTCACTGACATGCTGGACTGACATGCT
GGCTGCTGTTTCAAAGTGTAAAGTTTGTGTAGGGCTGTTGGGACAACTGCAACTCTGTTGTCAAGGTACTGTGCTTT
GGTTCCTATAGCAACACTGGGTGTGGCCCTTGAATTGCTAAGGGCATTTAATACATCCTGGAGCAAATTTTAACTGC
AGATTTTCTTTGTAGAAATTCTATGTATAATGCAGGTACCTACTTGGCCCATGGCTGGTAACTATTTGGGCAATTAG
AAAAAAAGAAAAAAACATAAAAACTAGTGTCTATTGCTGCTTTGAATATGTTTGAAAGTCTGAAAATGTAAATAGTT
TATCAAAAAAAAAATCTTGTACAGTCCAGTGTAAAGTTTTTAAATGACCTTAAGGGTTGCCATCACATCTTTCTCACA
CTCTCCTCTTGATAATAATAATAATAAAAAGTTTGCTAAGGATTAAAGAAATGGAAAAATAAAAAAAATCTCTTCA
AATTTACAGGAATGAATCATTGTTCTTAGCTTTGTTGCATACACAAACTTCTTGGATTTTGTTGTGCAGTATTGACG
TGAGATAAAGCTCAACATTGAATAATCTTTCAGTGGTACTTTTCAAAGTCTTCCCCTCCTCTGCCTCATAATTAAGG
GAAAAGACAAAATTGAAAGACACACTGTCTTTATCTATCCTGGTGTATGTTGGCACCTTAGCTACTTTTTTTTTTTC
CTTTTTGCACAAGGTGCTTTCCTGATATGTTCAACATGCCATCTTTGGGTGATAATGTATATGCCGTGATGGGGCTC
AGGCCCCTTAGGGGAGTGTCTATAAGAACTGCCTATTTATGCTCATTTACCTCAAGACTGTCCTCTCTACCCTAATC
TAGTTGTCATCACTCCATCTTTTGTACTGCTGTTGACA

FIGURE 29

TTTGCTGTCCGGCTGCCTAGGGTCTGGGAAGCTCGGGCACCCTCCCTCTCCGGGGCTCCTGCTCCCACCCCTCCGGC
CCCCCCACCGTCGCGCTCCTCCAGGCTGGGCCTGTGGCCGCGGTGCTTTTTAATTTTCCCCCAGCTCAGAATCTTGC
TGCTCGGCCCCCAGGAGAGCAACAACTCAACGGGAACGATGTGGAAGGTGTCAGCTCTGCTCTTCGTTTTGGGAAGC
GCGTCGCTCTGGGTCCTGGCAGAAGGAGCCAGCACAGGCCAGCCAGAAGATGACACTGAGACTACAGGTTTGGAAGG
CGGCGTTGCCATGCCAGGTGCCGAAGATGATGTGGTGACTCCAGGAACCAGCGAAGACCGCTATAAGTCTGGCTTGA
CAACTCTGGTGGCAACAAGTGTCAACAGTGTAACAGGCATTCGCATCGAGGATCTGCCAACTTCAGAAAGCACAGTC
CACGCGCAAGAACAAAGTCCAAGCGCCACAGCCTCAAACGTGGCCACCAGTCACTCCACGGAGAAAGTGGATGGAGA
CACACAGACAACAGTTGAGAAAGATGGTTTGTCAACAGTGACCCTGGTTGGAATCATAGTTGGGGTCTTACTAGCCA
TCGGYTTCATTGGTGGAATCATCGTTGTGGTTATGCGAAAAATGTCGGGAAGGCCCTAAAGAGCTGAAGGGTTACGC
CCTGCTGCCAACGTGCTTAAAAAAAGACCGTTTCTGACTCTGTGCCCTGTCCCTGAGCTCGTGGGAGAAGATGACCC
GTGGAACACTTGCCTGGCCCACTCAGAATCCACGGTGACCTCTCCGCTTGCCAAAATAACCGAAGAAAGACCGTTCA
CCAGACTTGGCTCCTCTAAACATTTGCTGTTCAAACATGTTTTTGAATATACATTCTATAAAAGATTATTTGAAAGA
CAAAATTCATAGAAAATGGAGCAAAACTGTATAAACTGATTTGTAACTAACACTGGACCATTGGATCGATATTAYAT
GCTGTAACCATGTGTCTCCGTCTGACCATTCTTGTTATTGTTAAAATGCAGAGGAATCTGGAAATATTTATATCCAC
GGAGTCCTTGGATCCAGTGCTACGTCAGTAAATAGCACCAGCATTTTGCAATTGCTGATCTGCTGAAATGTACACAT
TCTGGTCTAGTTTGGTCTATCTTTTAAAGCCTGATCTGGTGTGAATAATCAACTAGGAAATCTAAACTTGGATAACA
CGTGGTGAACAACTGCCTTTAGCTGGTCCAGATTAATCATTTCAAAGACATCCATTTTAGATCACAAGCAGGAAGTC
GATAGTCTCAAAGGCACTTTGTTTCTCCCAAGTAGGCCACCAGGCAGCCTCTAGAGTTGCTTTACCCAAATCCTTCT
CCAGCCATGACTTGGTGACTCTAAGCTTGCTCCCACCTGCCCCCTCCACTTCCCTCAGATGATGAGGAGCCAGGGCT
AAGGGGGCAGCCTTCTCTCTTCCCAGTGATGCACATCCTTCACATTGGCTGCTTTGTTCTGGAATATGGATATCTCA
GCCTGGATGCCGAGGAAGCTGCTGGATGCTTAATGGTGCTAGAGGCTCAAGTGTGTTTGAAACCAAGAGCCAGTTGT
CCCCCATGCAGAAAGAAATCCTGTGTGAGCCTCTGGTATGAGAAATAAAATCTGCCAGTTTTATAACATTCACTTTC
TGCCTCTGAGGAAAGATACAGGGAACAAAAATCAATTTGTACAGTCTTAATATTAAAAGCAGCTTGACTAAATACCT
GATTTAAAAATAGAAGACATCCCCAGTCCTCATGACATACCGCAAATATCTGTGGGGTCCTGTTGAAAAGAACAAAA
TAAAGGAGCCCAAGGGGTCATTCTGTCTCAGCACCATCCAGCCTGGCACTTCTCTTCCCATATATCCATTGGATTTT
TTTTTTTTTTTTCCTAAACAAAGTTTTTACACTGAGCAGATGCTCTGTCATGATGGCGGTTGTGCAATTCTGGTATC
CTCTAAATTTGTAAGCATTCATAAAAAAAAAAAAAAAAAAACTCGAGGGGGGGCCCGGWCCCAATTGCCCTATAGGGA
GTCGTATTACAATTCACTGSCCGCGTTTTACAACGTCGXGACTGGGAAAACCCTGGXGTTACCCAACTTAATCGCCT
TGCAGAA

FIGURE 30

TCACAGCAGCTGTGGCTGGGGAGCCCAGATGAAGTGTGGCTCTATCTTGTATGTGAGCACACCCACATTTTCACTGC
CATTATCTGGGACAGCAGAACCAGGTTTGGCTCAACAGATTTCTCTTTCCACCCATCTATTGCAGGTGTAGTGGTCT
TGCTGCTTCTCCAGGGAGGATCTGCCTACAAACTGGTTTGCTACTTTACCAACTGGTCCCAGGACCGGCAGGAACCA
GGAAAATTCACCCCTGAGAATATTGACCCCTTCCTATGCTCTCATCTCATCTATTCATTCGCCAGCATCGAAAACAA
CAAGGTTATCATCAAGGACAAGAGTGAAGTGATGCTCTACCAGACCATCAACAGTCTCAAAACCAAGAATCCCAAAC
TGAAAATTCTCTTGTCCATTGGAGGGTACCTGTTTGGTTCCAAAGGGTTCCACCCTATGGTGGATTCTTCTACATCA
CGCTTGGAATTCATTAACTCCATAATCCTGTTTCTGAGGAACCATAACTTTGATGGACTGGATGTAAGCTGGATCTA
CCCAGATCAGAAAGAAAACACTCATTTCACTGTGCTGATTCATGAGTTAGCAGAAGCCTTTCAGAAGGACTTCACAA
AATCCACCAAGGAAAGGCTTCTCTTGACTGCGGGCGTATCTGCAGGGAGGCAAATGATTGATAACAGCTATCAAGTT
GAGAAACTGGCAAAAGATCTGGATTTCATCAACCTCCTGTCCTTTGACTTCCATGGGTCTTGGGAAAAGCCCCTTAT
CACTGGCCACAACAGCCCTCTGAGCAAGGGGTGGCAGGACAGAGGGCCAAGCTCCTACTACAATGTGGAATATGCTG
TGGGGTACTGGATACATAAGGGAATGCCATCAGAGAAGGTGGTCATGGGCATCCCCACATATGGACACTCCTTCACA
CTGGCCTCTGCAGAAACCACCGTGGGGGCCCCTGCCTCTGGCCCTGGAGCTGCTGGACCCATCACAGAGTCTTCAGG
CTTCCTGGCCTATTATGAGATCTGCCAGTTCCTGAAAGGAGCCAAGATCACGCGGCTCCAGGATCAGCAGGTTCCCT
ACGCAGTCAAGGGGAACCAGTGGGTGGGCTATGATGATGTGAAGAGTATGGAGACCAAGGTTCAGTTCTTAAAGAAT
TTAAACCTGGGAGGAGCCATGATCTGGTCTATTGACATGGATGACTTCACTGGCAAATCCTGCAACCAGGGCCCTTA
CCCTCTTGTCCAAGCAGTCAAGAGAAGCCTTGGCTCCCTGTGAAGGATTAACTTACAGAGAAGCAGGCAAGATGACC
TTGCTGCCTGGGGCCTGCTCTCTCCCAGGAATTCTCATGTGGGATTCCCCTTGCCAGGATGGCCTTTGGATCTCTCT
TCCAAGCCTTTCCTGACTTCCTCTTAGATCATAGATTGGACCTGGTTTTGTTTTCCTGCAGCTGTTGACTTGTTGCC
CTGAAGTACAATAAAAAAAATTCATTTTGCTCCAGTA

FIGURE 31

CCCTTGAGACTCAAGATGATTCCCTTTTTACCCATGTTTTCTCTACTATTGCTGCTTATTGTTAACCCTATAAACGC
CAACAATCATTATGACAAGATCTTGGCTCATAGTCGTATCAGGGGTCGGGACCAAGGCCCAAATGTCTGTGCCCTTC
AACAGATTTTGGGCACCAAAAAGAAATACTTCAGCACTTGTAAGAACTGGTATAAAAAGTCCATCTGTGGACAGAAA
ACGACTGTGTTATATGAATGTTGCCCTGGTTATATGAGAATGGAAGGAATGAAAGGCTGCCCAGCAGTTTTGCCCAT
TGACCATGTTTATGGCACTCTGGGCATCGTGGGAGCCACCACAACGCAGCGCTATTCTGACGCCTCAAAACTGAGGG
AGGAGATCGAGGGAAAGGGATCCTTCACTTACTTTGCACCGAGTAATGAGGCTTGGGACAACTTGGATTCTGATATC
CGTAGAGGTTTGGAGAGCAACGTGAATGTTGAATTACTGAATGCTTTACATAGTCACATGATTAATAAGAGAATGTT
GACCAAGGACTTAAAAAATGGCATGATTATTCCTTCAATGTATAACAATTTGGGGCTTTTCATTAACCATTATCCTA
ATGGGGTTGTCACTGTTAATTGTGCTCGAATCATCCATGGGAACCAGATTGCAACAAATGGTGTTGTCCATGTCATT
GACCGTGTGCTTACACAAATTGGTACCTCAATTCAAGACTTCATTGAAGCAGAAGATGACCTTTCATCTTTTAGAGC
AGCTGCCATCACATCGGACATATTGGAGGCCCTTGGAAGAGACGGTCACTTCACACTCTTTGCTCCCACCAATGAGG
CTTTTGAGAAACTTCCACGAGGTGTCCTAGAAAGGATCATGGGAGACAAAGTGGCTTCCGAAGCTCTTATGAAGTAC
CACATCTTAAATACTCTCCAGTGTTCTGAGTCTATTATGGGAGGAGCAGTCTTTGAGACGCTGGAAGGAAATACAAT
TGAGATAGGATGTGACGGTGACAGTATAACAGTAAATGGAATCAAAATGGTGAACAAAAAGGATATTGTGACAAATA
ATGGTGTGATCCATTTGATTGATCAGGTCCTAATTCCTGATTCTGCCAAACAAGTTATTGAGCTGGCTGGAAAACAG
CAAACCACCTTCACGGATCTTGTGGCCCAATTAGGCTTGGCATCTGCTCTGAGGCCAGATGGAGAATACACTTTGCT
GGCACCTGTGAATAATGCATTTTCTGATGATACTCTCAGCATGGATCAGCGCCTCCTTAAATTAATTCTGCAGAATC
ACATATTGAAAGTAAAAGTTGGCCTTAATGAGCTTTACAACGGGCAAATACTGGAAACCATCGGAGGCAAACAGCTC
AGAGTCTTCGTATATCGTACAGCTGTCTGCATTGAAAATTCATGCATGGAGAAAGGGAGTAAGCAAGGGAGAAACGG
TGCGATTCACATATTCCGCGAGATCATCAAGCCAGCAGAGAAATCCCTCCATGAAAAGTTAAAACAAGATAAGCGCT
TTAGCACCTTCCTCAGCCTACTTGAAGCTGCAGACTTGAAAGAGCTCCTGACACAACCTGGAGACTGGACATTATTT
GTGCCAACCAATGATGCTTTTAAGGGAATGACTAGTGAAGAAAAAGAAATTCTGATACGGGACAAAAATGCTCTTCA
AAACATCATTCTTTATCACCTGACACCAGGAGTTTTCATTGGAAAAGGATTTGAACCTGGTGTTACTAACATTTTAA
AGACCACACAAGGAAGCAAAATCTTTCTGAAAGAAGTAAATGATACACTTCTGGTGAATGAATTGAAATCAAAAGAA
TCTGACATCATGACAACAAATGGTGTAATTCATGTTGTAGATAAACTCCTCTATCCAGCAGACACACCTGTTGGAAA
TGATCAACTGCTGGAAATACTTAATAAATTAATCAAATACATCCAAATTAAGTTTGTTCGTGGTAGCACCTTCAAAG
AAATCCCCGTGACTGTCTATAGACCCACACTAACAAAAGTCAAAATTGAAGGTGAACCTGAATTCAGACTGATTAAA
GAAGGTGAAACAATAACTGAAGTGATCCATGGAGAGCCAATTATTAAAAAATACACCAAAATCATTGATGGAGTGCC
TGTGGAAATAACTGAAAAAGAGACACGAGAAGAACGAATCATTACAGGTCCTGAAATAAAATACACTAGGATTTCTA
CTGGAGGTGGAGAAACAGAAGAAACTCTGAAGAAATTGTTACAAGAAGAGGTCACCAAGGTCACCAAATTCATTGAA
GGTGGTGATGGTCATTTATTTGAAGATGAAGAAATTAAAAGACTGCTTCAGGGAGACACACCCGTGAGGAAGTTGCA
AGCCAACAAAAAAGTTCAAGGATCTAGAAGACGATTAAGGGAAGGTCGTTCTCAGTGAAGGGC

FIGURE 32

GAGTTCACAGCATATATTGGTGGATTCTTGTCCATAGTGCATCTGCTTTAAGAATTAACGAAAGCAGTGTCAAGACA
GTAAGGATTCAAACCATTTGCCAAAAATGAGTCTAAGTGCATTTACTCTCTTCCTGGCATTGATTGGTGGTACCAGT
GGCCAGTACTATGATTATGATTTTCCCCTATCAATTTATGGGCAATCATCACCAAACTGTGCACCAGAATGTAACTG
CCCTGAAAGCTACCCAAGTGCCATGTACTGTGATGAGCTGAAATTGAAAAGTGTACCAATGGTGCCTCCTGGAATCA
AGTATCTTTACCTTAGGAATAACCAGATTGACCATATTGATGAAAAGGCCTTTGAGAATGTAACTGATCTGCAGTGG
CTCATTCTAGATCACAACCTTCTAGAAAACTCCAAGATAAAAGGGAGAGTTTTCTCTAAATTGAAACAACTGAAGAA
GCTGCATATAAACCACAACAACCTGACAGAGTCTGTGGGCCCACTTCCCAAATCTCTGGAGGATCTGCAGCTTACTC
ATAACAAGATCACAAAGCTGGGCTCTTTTGAAGGATTGGTAAACCTGACCTTCATCCATCTCCAGCACAATCGGCTG
AAAGAGGATGCTGTTTCAGCTGCTTTTAAAGGTCTTAAATCACTCGAATACCTTGACTTGAGCTTCAATCAGATAGC
CAGACTGCCTTCTGGTCTCCCTGTCTCTCTTCTAACTCTCTACTTAGACAACAATAAGATCAGCAACATCCCTGATG
AGTATTTCAAGCGTTTTAATGCATTGCAGTATCTGCGTTTATCTCACAACGAACTGGCTGATAGTGGAATACCTGGA
AATTCTTTCAATGTGTCATCCCTGGTTGAGCTGGATCTGTCCTATAACAAGCTTAAAAACATACCAACTGTCAATGA
AAACCTTGAAAACTATTACCTGGAGGTCAATCAACTTGAGAAGTTTGACATAAAGAGCTTCTGCAAGATCCTGGGGC
CATTATCCTACTCCAAGATCAAGCATTTGCGTTTGGATGGCAATCGCATCTCAGAAACCAGTCTTCCACCGGATATG
TATGAATGTCTACGTGTTGCTAACGAAGTCACTCTTAATTAATATCTGTATCCTGGAACAATATTTTATGGTTATGT
TTTTCTGTGTGTCAGTTTTCATAGTATCCATATTTTATTACTGTTTATTACTTCCATGAATTTTAAAATCTGAGGGA
AATGTTTTGTAAACATTTATTTTTTTTAAAGAAAAGATGAAAGGCAGGCCTATTTCATCACAAGAACACACACATAT
ACACGAATAGACATCAAACTCAATGCTTTATTTGTAAATTTAGTGTTTTTTTATTTCTACTGTCAAATGATGTGCAA
AACCTTTTACTGGTTGCATGGAAATCAGCCAAGTTTTATAATCCTTAAATCTTAATGTTCCTCAAAGCTTGGATTAA
ATACATATGGATGTTACTCTCTTGCACCAAATTATCTTGATACATTCAAATTTGTCTGGTTAAAAAATAGGTGGTAG
ATATTGAGGCCAAGAATATTGCAAAATACATGAAGCTTCATGCACTTAAAGAAGTATTTTTAGAATAAGAATTTGCA
TACTTACCTAGTGAAACTTTTCTAGAATTATTTTTCACTCTAAGTCATGTATGTTTCTCTTTGATTATTTGCATGTT
ATGTTTAATAAGCTACTAGCAAAATAAAACATAGCAAATGGCATCACTGTGTTTGACTTCTTGTGAAATTTCTGTAC
TTTGTATATAAAATACATAAAACAATAGATTAGAAATC

FIGURE 33

GAAGGAGGCCCAGACAGTGAGGGCAGGAGGGAGAGAAGAGACGCAGAAGGAGAGCGAGCGAGAGAGAAAGGGTTCTG
GATTGGAGGGGAGAGCAAGGGAGGGAGGAAGGCGGTGAGAGAGGCGGGGGCCTCGGGAGGGTGAAAGGAGGGAGGAG
AAGGGCGGGGCACGGAGGCCCGAGCGAGGGACAAGACTCCGACTCCAGCTCTGACTTTTTTCGCGGCTCTCGGCTTC
CACTGCAGCCATGTCACTCCTCTTGCTGGTGGTCTCAGCCCTTCACATCCTCATTCTTATACTGCTTTTCGTGGCCA
CTTTGGACAAGTCCTGGTGGACTCTCCCTGGGAAAGAGTCCCTGAATCTCTGGTACGACTGCACGTGGAACAACGAC
ACCAAAACATGGGCCTGCAGTAATGTCAGCGAGAATGGCTGGCTGAAGGCGGTGCAGGTCCTCATGGTGCTCTCCCT
CATTCTCTGCTGTCTCTCCTTCATCCTGTTCATGTTCCAGCTCTACACCATGCGACGAGGAGGTCTCTTCTATGCCA
CCGGCCTCTGCCAGCTTTGCACCAGCGTGGCGGTGTTTACTGGCGCCTTGATCTATGCCATTCACGCCGAGGAGATC
CTGGAGAAGCACCCGCGAGGGGGCAGCTTCGGATACTGCTTCGCCCTGGCCTGGGTGGCCTTCCCCCTCGCCCTGGT
CAGCGGCATCATCTACATCCACCTACGGAAGCGGGAGTGAGCGCCCCGCCTCGCTCGGCTGCCCCCGCCCCTTCCCG
GCCCCCCTCGCCGCGCGTCCTCCAAAAAAATAAAACTTTAACGGCGG

FIGURE 34

CCGGGTCGACTACTACTACTACTAAATTCGCGGCCGCGTCGACCGCCCCTTGGCTTCTGCACTGATGGTGGGTGGAT
GAGTAATGCATCCAGGAAGCCTGGAGGCCTGTGGTTTCCGCACCCGCTGCCACCCCCGCCCCTAGCGTGGACATTTA
TCCTCTAGCGCTCAGGCCCTGCCGCCATCGCCGCAGATCCAGCGCCCAGAGAGACACCAGAGAACCCACCATGGCCC
CCTTTGAGCCCCTGGCTTCTGGCATCCTGTTGTTGCTGTGGCTGATAGCCCCCAGCAGGGCCTGCACCTGTGTCCCA
CCCCACCCACAGACGGCCTTCTGCAATTCCGACCTCGTCATCAGGGCCAAGTTCGTGGGGACACCAGAAGTCAACCA
GACCACCTTATACCAGCGTTATGAGATCAAGATGACCAAGATGTATAAAGGGTTCCAAGCCTTAGGGGATGCCGCTG
ACATCCGGTTCGTCTACACCCCCGCCATGGAGAGTGTCTGCGGATACTTCCACAGGTCCCACAACCGCAGCGAGGAG
TTTCTCATTGCTGGAAAACTGCAGGATGGACTCTTGCACATCACTACCTGCAGTTTCGTGGCTCCCTGGAACAGCCT
GAGCTTAGCTCAGCGCCGGGGCTTCACCAAGACCTACACTGTTGGCTGTGAGGAATGCACAGTGTTTCCCTGTTTAT
CCATCCCCTGCAAACTGCAGAGTGGCACTCATTGCTTGTGGACGGACCAGCTCCTCCAAGGCTCTGAAAAGGGCTTC
CAGTCCCGTCACCTTGCCTGCCTGCCTCGGGAGCCAGGGCTGTGCACCTGGCAGTCCCTGCGGTCCCAGATAGCCTG
AATCCTGCCCGGAGTGGAAGCTGAAGCCTGCACAGTGTCCACCCTGTTCCCACTCCCATCTTTCTTCCGGACAATGA
AATAAAGAGTTACCACCCAGCA

FIGURE 35

AGTGGAGTGGGACAGGTATATAAAGGAAGTACAGGGCCTGGGGAAGAGGCCCTGTCTAGGTAGCTGGCACCAGGAGC
CGTGGGCAAGGGAAGAGGCCACACCCTGCCCTGCTCTGCTGCAGCCAGAATGGGTGTGAAGGCGTCTCAAACAGGCT
TTGTGGTCCTGGTGCTGCTCCAGTGCTGCTCTGCATACAAACTGGTCTGCTACTACACCAGCTGGTCCCAGTACCGG
GAAGGCGATGGGAGCTGCTTCCCAGATGCCCTTGACCGCTTCCTCTGTACCCACATCATCTACAGCTTTGCCAATAT
AAGCAACGATCACATCGACACCTGGGAGTGGAATGATGTGACGCTCTACGGCATGCTCAACACACTCAAGAACAGGA
ACCCCAACCTGAAGACTCTCTTGTCTGTCGGAGGATGGAACTTTGGGTCTCAAAGATTTTCCAAGATAGCCTCCAAC
ACCCAGAGTCGCCGGACTTTCATCAAGTCAGTACCGCCATTCCTGCGCACCCATGGCTTTGATGGGCTGGACCTTGC
CTGGCTCTACCCTGGACGGAGAGACAAACAGCATTTTACCACCCTAATCAAGGAAATGAAGGCCGAATTTATAAAGG
AAGCCCAGCCAGGGAAAAAGCAGCTCCTGCTCAGCGCAGCACTGTCTGCGGGGAAGGTCACCATTGACAGCAGCTAT
GACATTGCCAAGATATCCCAACACCTGGATTTCATTAGCATCATGACCTACGATTTTCATGGAGCCTGGCGTGGGAC
CACAGGCCATCACAGTCCCCTGTTCCGAGGTCAGGAGGATGCAAGTCCTGACAGATTCAGCAACACTGACTATGCTG
TGGGGTACATGTTGAGGCTGGGGGCTCCTGCCAGTAAGCTGGTGATGGGCATCCCCACCTTCGGGAGGAGCTTCACT
CTGGCTTCTTCTGAGACTGGTGTTGGAGCCCCAATCTCAGGACCGGGAATTCCAGGCCGGTTCACCAAGGAGGCAGG
GACCCTTGCCTACTATGAGATCTGTGACTTCCTCCGCGGAGCCACAGTCCATAGAACCCTCGGCCAGCAGGTCCCCT
ATGCCACCAAGGGCAACCAGTGGGTAGGATACGACGACCAGGAAAGCGTCAAAAGCAAGGTGCAGTACCTGAAGGAT
AGGCAGCTGGCAGGCGCCATGGTATGGGCCCTGGACCTGGATGACTTCCAGGGCTCCTTCTGCGGCCAGGATCTGCG
CTTCCCTCTCACCAATGCCATCAAGGATGCACTCGCTGCAACGTAGCCCTCTGTTCTGCACACAGCACGGGGGCCAA
GGATGCCCCGTCCCCCTCTGGCTCCAGCTGGCCGGGAGCCTGATCACCTGCCCTGCTGAGTCCCAGGCTGAGCCTCA
GTCTCCCTCCCTTGGGGCCTATGCAGAGGTCCACAACACACAGATTTGAGCTCAGCCCTGGTGGGCAGAGAGGTAGG
GATGGGGCTGTGGGGATAGTGAGGCATCGCAATGTAAGACTCGGGATTAGTACACACTTGTTGATGATTAATGGAAA
TGTTTACAGATCCCCAAGCCTGGCAAGGGAATTTCTTCAACTCCCTGCCCCCTAGCCCTCCTTATCAAAGGACACCA
TTTTGGCAAGCTCTATCACCAAGGAGCCAAACATCCTACAAGACACAGTGACCATACTAATTATACCCCCTGCAAAG
CCAGCTTGAAACCTTCACTTAGGAACGTAATCGTGTCCCCTATCCTACTTCCCCTTCCTAATTCCACAGCTGCTCAA
TAAAGTACAAGAGTTTAACAGTGTGTTGGCGCTTTGCTTTGGTCTATCTTTGAGCGCCCACTAGACCCACTGGACTC
ACCTCCCCCATCTCTTCTGGGTTCCTTCCTCTGAGCCTTGGGACCCCTGAGCTTGCAGAGATGAAGGCCGCCATGTT

FIGURE 36

CCCGCGCCCTCCGTTCGCTCCGGACACCATGGACAAGTTTTGGTGGCACGCAGCCTGGGGACTCTGCCTCGTGCCGC
TGAGCCTGGCGCAGATCGATTTGAATATAACCTGCCGCTTTGCAGGTGTATTCCACGTGGAGAAAAATGGTCGCTAC
AGCATCTCTCGGACGGAGGCCGCTGACCTCTGCAAGGCTTTCAATAGCACCTTGCCCACAATGGCCCAGATGGAGAA
AGCTCTGAGCATCGGATTTGAGACCTGCAGGTATGGGTTCATAGAAGGGCATGTGGTGATTCCCCGGATCCACCCCA
ACTCCATCTGTGCAGCAAACAACACAGGGGTGTACATCCTCACATACAACACCTCCCAGTATGACACATATTGCTTC
AATGCTTCAGCTCCACCTGAAGAAGATTGTACATCAGTCACAGACCTGCCCAATGCCTTTGATGGACCAATTACCAT
AACTATTGTTAACCGTGATGGCACCCGCTATGTCCAGAAAGGAGAATACAGAACGAATCCTGAAGACATCTACCCCA
GCAACCCTACTGATGATGACGTGAGCAGCGGCTCCTCCAGTGAAAGGAGCAGCACTTCAGGAGGTTACATCTTTTAC
ACCTTTTCTACTGTACACCCCATCCCAGACGAAGACAGTCCCTGGATCACCGACAGCACAGACAGAATCCCTGCTAC
CAGAGACCAAGACACATTCCACCCCAGTGGGGGGTCCCATACCACTCATGGATCTGAATCAGATGGACACTCACATG
GGAGTCAAGAAGGTGGAGCAAACACAACCTCTGGTCCTATAAGGACACCCCAAATTCCAGAATGGCTGATCATCTTG
GCATCCCTCTTGGCCTTGGCTTTGATTCTTGCAGTTTGCATTGCAGTCAACAGTCGAAGAAGGTGTGGGCAGAAGAA
AAAGCTAGTGATCAACAGTGGCAATGGAGCTGTGGAGGACAGAAAGCCAAGTGGACTCAACGGAGAGGCCAGCAAGT
CTCAGGAAATGGTGCATTTGGTGAACAAGGAGTCGTCAGAAACTCCAGACCAGTTTATGACAGCTGATGAGACAAGG
AACCTGCAGAATGTGGACATGAAGATTGGGGTGTAACACCTACACCATTATCTTGGAAAGAAACAACCGTTGGAAAC
ATAACCATTACAGGGAGCTGGGACACTTAACAGATGCAATGTGCTACTGATTGTTTCATTGCGAATCTTTTTTAGCA
TAAAATTTTCTACTCTTTTTGTTTTTTGTGTTTTGTTCTTTAAAGTCAGGTCCAATTTGTAAAAACAGCATTGCTTT
GTAAATTAGGGCCCAATTAATAATCAGCAAGAATTTGATCGTTCAGTTCCACTTGGAGGCCTTCATCCTCGGGTGTG
CTATGGATGGCTTCTAACAAAAACTACACATATGTATTCCTGATCGCCAACCTTTCCCCCACCAGCTAAGGACATTT
CCCAGGGTTAATAGGGCCTGGTCCCTGGGAGGAAATTTGAATGGGTCCATTTTGCCCTTCCATAGCCTAATCCCTGG
GCATTGCTTTCCACTGAGGTTGGGGTGTACTAGTTACACATCTTCAACAGACCCCCTCTAGAAATTTTTCAGATGCT
TCTGGGAGACACCAAAGGGTGAAGCTATTTATCTGTAGTAAACTATTTATCTGTGTTTTTGAAATATTAAACCCTGG
ATCAGTCCTTTGATCAGTATAATTTTTTAAAGTTACTTTGTCAGAGGCACAAAAGGGTTTAAACTGATTCATAATAA
ATATCTGTACTTCTTCGATCTTC

FIGURE 37A

ACCGGCCACAGCCTGCCTACTGTCACCCGCCTCTCCCGCGCGCAGATACACGCCCCCGCCTCCGTGGGCACAAAGGC
AGCGCTGCTGGGGAACTCGGGGGAACGCGCACGTGGGAACCGCCGCAGCTCCACACTCCAGGTACTTCTTCCAAGGA
CCTAGGTCTCTCGCCCATCGGAAAGAAAATAATTCTTTCAAGAAGATCAGGGACAACTGATTTGAAGTCTACTCTGT
GCTTCTAAATCCCCAATTCTGCTGAAAGTGAATCCCTAGAGCCCTAGAGCCCCAGCAGCACCCAGCCAAACCCACCT
CCACC<u>ATG</u>GGGGCCATGACTCAGCTGTTGGCAGGTGTCTTTCTTGCTTTCCTTGCCCTCGCTACCGAAGGTGGGGTC
CTCAAGAAAGTCATCCGGCACAAGCGACAGAGTGGGGTGAACGCCACCCTGCCAGAAGAGAACCAGCCAGTGGTGTT
TAACCACGTTTACAACATCAAGCTGCCAGTGGGATCCCAGTGTTCGGTGGATCTGGAGTCAGCCAGTGGGGAGAAAG
ACCTGGCACCGCCTTCAGAGCCCAGCGAAAGCTTTCAGGAGCACACAGTAGATGGGGAAAACCAGATTGTCTTCACA
CATCGCATCAACATCCCCCGCCGGGCCTGTGGCTGTGCCGCAGCCCCTGATGTTAAGGAGCTGCTGAGCAGACTGGA
GGAGCTGGAGAACCTGGTGTCTTCCCTGAGGGAGCAATGTACTGCAGGAGCAGGCTGCTGTCTCCAGCCTGCCACAG
GCCGCTTGGACACCAGGCCCTTCTGTAGCGGTCGGGGCAACTTCAGCACTGAAGGATGTGGCTGTGTCTGCGAACCT
GGCTGGAAAGGCCCCAACTGCTCTGAGCCCGAATGTCCAGGCAACTGTCACCTTCGAGGCCGGTGCATTGATGGGCA
GTGCATCTGTGACGACGGCTTCACGGGCGAGGACTGCAGCCAGCTGGCTTGCCCCAGCGACTGCAATGACCAGGGCA
AGTGCGTGAATGGAGTCTGCATCTGTTTCGAAGGCTACGCCGGGGCTGACTGCAGCCGTGAAATCTGCCCAGTGCCC
TGCAGTGAGGAGCACGGCACATGTGTAGATGGCTTGTGTGTGTGCCACGATGGCTTTGCAGGCGATGACTGCAACAA
GCCTCTGTGTCTCAACAATTGCTACAACCGTGGACGATGCGTGGAGAATGAGTGCGTGTGTGATGAGGGTTTCACGG
GCGAAGACTGCAGTGAGCTCATCTGCCCCAATGACTGCTTCGACCGGGGCCGCTGCATCAATGGCACCTGCTACTGC
GAAGAAGGCTTCACAGGTGAAGACTGCGGGAAACCCACCTGCCCACATGCCTGCCACACCCAGGGCCGGTGTGAGGA
GGGGCAGTGTGTATGTGATGAGGGCTTTGCCGGTTTGGACTGCAGCGAGAAGAGGTGTCCTGCTGACTGTCACAATC
GTGGCCGCTGTGTAGACGGGCGGTGTGAGTGTGATGATGGTTTCACTGGAGCTGACTGTGGGGAGCTCAAGTGTCCC
AATGGCTGCAGTGGCCATGGCCGCTGTGTCAATGGGCAGTGTGTGTGTGATGAGGGCTATACTGGGGAGGACTGCAG
CCAGCTACGGTGCCCCAATGACTGTCACAGTCGGGGCCGCTGTGTCGAGGGCAAATGTGTATGTGAGCAAGGCTTCA
AGGGCTATGACTGCAGTGACATGAGCTGCCCTAATGACTGTCACCAGCACGGCCGCTGTGTGAATGGCATGTGTGTT
TGTGATGACGGCTACACAGGGGAAGACTGCCGGGATCGCCAATGCCCCAGGGACTGCAGCAACAGGGGCCTCTGTGT
GGACGGACAGTGCGTCTGTGAGGACGGCTTCACCGGCCCTGACTGTGCAGAACTCTCCTGTCCAAATGACTGCCATG
GCCAGGGTCGCTGTGTGAATGGGCAGTGCGTGTGCCATGAAGGATTTATGGGCAAAGACTGCAAGGAGCAAAGATGT
CCCAGTGACTGTCATGGCCAGGGCCGCTGCGTGGACGGCCAGTGCATCTGCCACGAGGGCTTCACAGGCCTGGACTG
TGGCCAGCACTCCTGCCCCAGTGACTGCAACAACTTAGGACAATGCGTCTCGGGCCGCTGCATCTGCAACGAGGGCT
ACAGCGGAGAAGACTGCTCAGAGGTGTCTCCTCCCAAAGACCTCGTTGTGACAGAAGTGACGGAAGAGACGGTCAAC
CTGGCCTGGGACAATGAGATGCGGGTCACAGAGTACCTTGTCGTGTACACGCCCACCCACGAGGGTGGTCTGGAAAT
GCAGTTCCGTGTGCCTGGGGACCAGACGTCCACCATCATCCAGGAGCTGGAGCCTGGTGTGGAGTACTTTATCCGTG
TATTTGCCATCCTGGAGAACAAGAAGAGCATTCCTGTCAGCGCCAGGGTGGCCACGTACTTACCTGCACCTGAAGGC
CTGAAATTCAAGTCCATCAAGGAGACATCTGTGGAAGTGGAGTGGGATCCTCTAGACATTGCTTTTGAAACCTGGGA
GATCATCTTCCGGAATATGAATAAAGAAGATGAGGGAGAGATCACCAAAAGCCTGAGGAGGCCAGAGACCTCTTACC
GGCAAACTGGTCTAGCTCCTGGGCAAGAGTATGAGATATCTCTGCACATAGTGAAAAACAATACCCGGGGCCCTGGC
CTGAAGAGGGTGACCACCACACGCTTGGATGCCCCCAGCCAGATCGAGGTGAAAGATGTCACAGACACCACTGCCTT
GATCACCTGGTTCAAGCCCCTGGCTGAGATCGATGGCATTGAGCTGACCTACGGCATCAAAGACGTGCCAGGAGACC
GTACCACCATCGATCTCACAGAGGACGAGAACCAGTACTCCATCGGGAACCTGAAGCCTGACACTGAGTACGAGGTG
TCCCTCATCTCCCGCAGAGGTGACATGTCAAGCAACCCAGCCAAAGAGACCTTCACAACAGGCCTCGATGCTCCCAG
GAATCTTCGACGTGTTTCCCAGACAGATAACAGCATCACCCTGGAATGGAGGAATGGCAAGGCAGCTATTGACAGTT
ACAGAATTAAGTATGCCCCCATCTCTGGAGGGGACCACGCTGAGGTTGATGTTCCAAAGAGCCAACAAGCCACAACC
AAAACCACACTCACAGGTCTGAGGCCGGGAACTGAATATGGGATTGGAGTTTCTGCTGTGAAGGAAGACAAGGAGAG
CAATCCAGCGACCATCAACGCAGCCACAGAGTTGGACACGCCCAAGGACCTTCAGGTTTCTGAAACTGCAGAGACCA
GCCTGACCCTGCTCTGGAAGACACCGTTGGCCAAATTTGACCGCTACCGCCTCAATTACAGTCTCCCCACAGGCCAG
TGGGTGGGAGTGCAGCTTCCAAGAAACACCACTTCCTATGTCCTGAGAGGCCTGGAACCAGGACAGGAGTACAATGT
CCTCCTGACAGCCGAGAAAGGCAGACACAAGAGCAAGCCCGCACGTGTGAAGGCATCCACTGAACAAGCCCCTGAGC
TGGAAAACCTCACCGTGACTGAGGTTGGCTGGGATGGCCTCAGACTCAACTGGACCGCGGCTGACCAGGCCTATGAG
CACTTTATCATTCAGGTGCAGGAGGCCAACAAGGTGGAGGCAGCTCGGAACCTCACCGTGCCTGGCAGCCTTCGGGC
TGTGGACATACCGGGCCTCAAGGCTGCTACGCCTTATACAGTCTCCATCTATGGGGTGATCCAGGGCTATAGAACAC
CAGTGCTCTCTGCTGAGGCCTCCACAGGGGAAACTCCCAATTTGGGAGAGGTCGTGGTGGCCGAGGTGGGCTGGGAT
GCCCTCAAACTCAACTGGACTGCTCCAGAAGGGGCCTATGAGTACTTTTTCATTCAGGTGCAGGAGGCTGACACAGT
AGAGGCAGCCCAGAACCTCACCGTCCCAGGAGGACTGAGGTCCACAGACCTGCCTGGGCTCAAAGCAGCCACTCATT
ATACCATCACCATCCGCGGGGTCACTCAGGACTTCAGCACAACCCCTCTCTCTGTTGAAGTCTTGACAGAGGAGGTT
CCAGATATGGGAAACCTCACAGTGACCGAGGTTAGCTGGGATGCTCTCAGACTGAACTGGACCACGCCAGATGGAAC
CTATGACCAGTTTACTATTCAGGTCCAGGAGGCTGACCAGGTGGAAGAGGCTCACAATCTCACGGTTCCTGGCAGCC
TGCGTTCCATGGAAATCCCAGGCCTCAGGGCTGGCACTCCTTACACAGTCACCCTGCACGGCGAGGTCAGGGGCCAC
AGCACTCGACCCCTTGCTGTAGAGGTCGTCACAGAGGATCTCCCACAGCTGGGAGATTTAGCCGTGTCTGAGGTTGG
CTGGGATGGCCTCAGACTCAACTGGACCGCAGCTGACAATGCCTATGAGCACTTTGTCATTCAGGTGCAGGAGGTCA
ACAAAGTGGAGGCAGCCCAGAACCTCACGTTGCCTGGCAGCCTCAGGGCTGTGGACATCCCGGGCCTCGAGGCTGCC
ACGCCTTATAGAGTCTCCATCTATGGGGTGATCCGGGGCTATAGAACACCAGTACTCTCTGCTGAGGCCTCCACAGC
CAAAGAACCTGAAATTGGAAACTTAAATGTTTCTGACATAACTCCCGAGAGCTTCAATCTCTCCTGGATGGCTACCG
ATGGGATCTTCGAGACCTTTACCATTGAAATTATTGATTCCAATAGGTTGCTGGAGACTGTGGAATATAATATCTCT

FIGURE 37B

GGTGCTGAACGAACTGCCCATATCTCAGGGCTACCCCCTAGTACTGATTTTATTGTCTACCTCTCTGGACTTGCTCC
CAGCATCCGGACCAAAACCATCAGTGCCACAGCCACGACAGAGGCCCTGCCCCTTCTGGAAAACCTAACCATTTCCG
ACATTAATCCCTACGGGTTCACAGTTTCCTGGATGGCATCGGAGAATGCCTTTGACAGCTTTCTAGTAACGGTGGTG
GATTCTGGGAAGCTGCTGGACCCCCAGGAATTCACACTTTCAGGAACCCAGAGGAAGCTGGAGCTTAGAGGCCTCAT
AACTGGCATTGGCTATGAGGTTATGGTCTCTGGCTTCACCCAAGGGCATCAAACCAAGCCCTTGAGGGCTGAGATTG
TTACAGAAGCCGAACCGGAAGTTGACAACCTTCTGGTTTCAGATGCCACCCCAGACGGTTTCCGTCTGTCCTGGACA
GCTGATGAAGGGGTCTTCGACAATTTTGTTCTCAAAATCAGAGATACCAAAAAGCAGTCTGAGCCACTGGAAATAAC
CCTACTTGCCCCCGAACGTACCAGGGACTTAACAGGTCTCAGAGAGGCTACTGAATACGAAATTGAACTCTATGGAA
TAAGCAAAGGAAGGCGATCCCAGACAGTCAGTGCTATAGCAACAACAGCCATGGGCTCCCCAAAGGAAGTCATTTTC
TCAGACATCACTGAAAATTCGGCTACTGTCAGCTGGAGGGCACCCACGGCCCAAGTGGAGAGCTTCCGGATTACCTA
TGTGCCCATTACAGGAGGTACACCCTCCATGGTAACTGTGGACGGAACCAAGACTCAGACCAGGCTGGTGAAACTCA
TACCTGGCGTGGAGTACCTTGTCAGCATCATCGCCATGAAGGGCTTTGAGGAAAGTGAACCTGTCTCAGGGTCATTC
ACCACAGCTCTGGATGGCCCATCTGGCCTGGTGACAGCCAACATCACTGACTCAGAAGCCTTGGCCAGGTGGCAGCC
AGCCATTGCCACTGTGGACAGTTATGTCATCTCCTACACAGGCGAGAAAGTGCCAGAAATTACACGCACGGTGTCCG
GGAACACAGTGGAGTATGCTCTGACCGACCTCGAGCCTGCCACGGAATACACACTGAGAATCTTTGCAGAGAAAGGG
CCCCAGAAGAGCTCAACCATCACTGCCAAGTTCACAACAGACCTCGATTCTCCAAGAGACTTGACTGCTACTGAGGT
TCAGTCGGAAACTGCCCTCCTTACCTGGCGACCCCCCCGGGCATCAGTCACCGGTTACCTGCTGGTCTATGAATCAG
TGGATGGCACAGTCAAGGAAGTCATTGTGGGTCCAGATACCACCTCCTACAGCCTGGCAGACCTGAGCCCATCCACC
CACTACACAGCCAAGATCCAGGCACTCAATGGGCCCCTGAGGAGCAATATGATCCAGACCATCTTCACCACAATTGG
ACTCCTGTACCCCTTCCCCAAGGACTGCTCCCAAGCAATGCTGAATGGAGACACGACCTCTGGCCTCTACACCATTT
ATCTGAATGGTGATAAGGCTCAGGCGCTGGAAGTCTTCTGTGACATGACCTCTGATGGGGGTGGATGGATTGTGTTC
CTGAGACGCAAAAACGGACGCGAGAACTTCTACCAAAACTGGAAGGCATATGCTGCTGGATTTGGGGACCGCAGAGA
AGAATTCTGGCTTGGGCTGGACAACCTGAACAAAATCACAGCCCAGGGGCAGTACGAGCTCCGGGTGGACCTGCGGG
ACCATGGGGAGACAGCCTTTGCTGTCTATGACAAGTTCAGCGTGGGAGATGCCAAGACTCGCTACAAGCTGAAGGTG
GAGGGGTACAGTGGGACAGCAGGTGACTCCATGGCCTACCACAATGGCAGATCCTTCTCCACCTTTGACAAGGACAC
AGATTCAGCCATCACCAACTGTGCTCTGTCCTACAAAGGGGCTTTCTGGTACAGGAACTGTCACCGTGTCAACCTGA
TGGGGAGATATGGGGACAATAACCACAGTCAGGGCGTTAACTGGTTCCACTGGAAGGGCCACGAACACTCAATCCAG
TTTGCTGAGATGAAGCTGAGACCAAGCAACTTCAGAAATCTTGAAGGCAGGCGCAAACGGGCATAAATTGGAGGGAC
CACTGGGTGAGAGAGGAATAAGGCGGCCCAGAGCGAGGAAAGGATTTTACCAAAGCATCAATACAACCAGCCCAACC
ATCGGTCCACACCTGGGCATTTGGTGAGAATCAAAGCTGACCATGGATCCCTGGGGCCAACGGCAACAGCATGGGCC
TCACCTCCTCTGTGATTTCTTTCTTTGCACCAAAGACATCAGTCTCCAACATGTTTCTGTTTTGTTGTTTGATTCAG
CAAAAATCTCCCAGTGACAACATCGCAATAGTTTTTTACTTCTCTTAGGTGGCTCTGGGATGGGAGAGGGGTAGGAT
GTACAGGGGTAGTTTGTTTTAGAACCAGCCGTATTTTACATGAAGCTGTATAATTAATTGTCATTATTTTTGTTAGC
AAAGATTAAATGTGTCATTGGAAGCCATCCCTTTTTTTACATTTCATACAACAGAAACCAGAAAAGCAATACTGTTT
CCATTTTAAGGATATGATTAATATTATTAATATAATAATGATGATGATGATGATGAAAACTAAGGATTTTTCAAGAG
ATCTTTCTTTCCAAAACATTTCTGGACAGTACCTGATTGTATTTTTTTTTTAAATAAAAGCACAAGTACTTTTGAAA
AAAAACCGGAATTC

FIGURE 38

CGCGCGGCCCCTGTCCTCCGGCCCGAGATGAATCCTGCGGCAGAAGCCGAGTTCAACATCCTCCTGGCCACCGACTC
CTACAAGGTTACTCACTATAAACAATATCCACCCAACACAAGCAAAGTTTATTCCTACTTTGAATGCCGTGAAAAGA
AGACAGAAAACTCCAAATTAAGGAAGGTGAAATATGAGGAAACAGTATTTTATGGGTTGCAGTACATTCTTAATAAG
TACTTAAAAGGTAAAGTAGTAACCAAAGAGAAAATCCAGGAAGCCAAAGATGTCTACAAAGAACATTTCCAAGATGA
TGTCTTTAATGAAAAGGGATGGAACTACATTCTTGAGAAGTATGATGGGCATCTTCCAATAGAAATAAAAGCTGTTC
CTGAGGGCTTTGTCATTCCCAGAGGAAATGTTCTCTTCACGGTGGAAAACACAGATCCAGAGTGTTACTGGCTTACA
AATTGGATTGAGACTATTCTTGTTCAGTCCTGGTATCCAATCACAGTGGCCACAAATTCTAGAGAGCAGAAGAAAAT
ATTGGCCAAATATTTGTTAGAAACTTCTGGTAACTTAGATGGTCTGGAATACAAGTTACATGATTTTGGCTACAGAG
GAGTCTCTTCCCAAGAGACTGCTGGCATAGGAGCATCTGCTCACTTGGTTAACTTCAAAGGAACAGATACAGTAGCA
GGACTTGCTCTAATTAAAAAATATTATGGAACGAAAGATCCTGTTCCAGGCTATTCTGTTCCAGCAGCAGAACACAG
TACCATAACAGCTTGGGGGAAAGACCATGAAAAAGATGCTTTTGAACATATTGTAACACAGTTTTCATCAGTGCCTG
TATCTGTGGTCAGCGATAGCTATGACATTTATAATGCGTGTGAGAAAATATGGGGTGAAGATCTAAGACATTTAATA
GTATCGAGAAGTACACAGGCACCACTAATAATCAGACCTGATTCTGGAAACCCTCTTGACACTGTGTTAAAGGTTTT
GGAGATTTTAGGTAAGAAGTTTCCTGTTACTGAGAACTCAAAGGGTTACAAGTTGCTGCCACCTTATCTTAGAGTTA
TTCAAGGGGATGGAGTAGATATTAATACCTTACAAGAGATTGTAGAAGGCATGAAACAAAAAATGTGGAGTATTGAA
AATATTGCCTTCGGTTCTGGTGGAGGTTTGCTACAGAAGTTGACAAGAGATCTCTTGAATTGTTCCTTCAAGTGTAG
CTATGTTGTAACTAATGGCCTTGGGATTAACGTCTTCAAGGACCCAGTTGCTGATCCCAACAAAAGGTCCAAAAAGG
GCCGATTATCTTTACATAGGACGCCAGCAGGGAATTTTGTTACACTGGAGGAAGGAAAAGGAGACCTTGAGGAATAT
GGTCAGGATCTTCTCCATACTGTCTTCAAGAATGGCAAGGTGACAAAAAGCTATTCATTTGATGAAATAAGAAAAAA
TGCACAGCTGAATATTGAACTGGAAGCAGCACATCATTAGGCTTTATGACTGGGTGTGTGTTGTGTGTATGTAATAC
ATAATGTTTATTGTACAGATGTGTGGGGTTTGTGTTTTATGATACATTACAGCCAAATTATTTGTTGGTTTATGGAC
ATACTGCCCTTTCATTTTTTTTCTTTTCCAGTGTTTAGGTGATCTCAAATTAGGAAATGCATTTAACCATGTAAAAG
ATGAGTGCTAAAGTAAGCTTTTTAGGGCCCTTTGCCAATAGGTAGTCATTCAATCTGGTATTGATCTTTTCACAAAT
AACAGAACTGAGAAACTTTTATATATAACTGATGATCACATAAAACAGATTTGCATAAAATTACCATGATTGCTTTA
TGTTTATATTTAACTTGTATTTTTGTACAAACAAGATTGTGTAAGATATATTTGAAGTTTCAGTGATTTAACAGTCT
TTCCAACTTTTCATGATTTTTATGAGCACAGACTTTCAAGAAAATACTTGAAAATAAATTACATTGCCTTTTGTCCA
TTAATCAGCAAATAAAACATGGCCTTAACAAAGTTGTTTGTGTTATTGTACAATTTGAAAATTATGTCGGGACATAC
CCTATAGAATTACTAACCTTACTGCCCCTTGTAGAATATGTATTAATCATTCTACATTAAAGAAAATAATGGTTCTT
ACTGGAATGTCTAGGCACTGTACAGTTATTATATATCTTGGTTGTTGTATTGTACCAGTGAAATGCCAAATTTGAAA
GGCCTGTACTGCAATTTTATATGTCAGAGATTGCCTGTGGCTCTAATATGCACCTCAAGATTTTAAGGAGATAATGT
TTTTAGAGAGAATTTCTGCTTCCACTATAGAATATATACATAAATGTAAAATACTTACAAAAGTGG

FIGURE 39

GCCCGCTTGCCCGTCGGTCGCTAGCTCGCTCGGTGCGCGTCGTCCCGCTCCATGGCGCTCTTCGTGCGGCTGCTGGC
TCTCGCCCTGGCTCTGGCCCTGGGCCCCGCCGCGACCCTGGCGGGTCCCGCCAAGTCGCCCTACCAGCTGGTGCTGC
AGCACAGCAGGCTCCGGGGCCGCCAGCACGGCCCCAACGTGTGTGCTGTGCAGAAGGTTATTGGCACTAATAGGAAG
TACTTCACCAACTGCAAGCAGTGGTACCAAAGGAAAATCTGTGGCAAATCAACAGTCATCAGCTACGAGTGCTGTCC
TGGATATGAAAAGGTCCCTGGGGAGAAGGGCTGTCCAGCAGCCCTACCACTCTCAAACCTTTACGAGACCCTGGGAG
TCGTTGGATCCACCACCACTCAGCTGTACACGGACCGCACGGAGAAGCTGAGGCCTGAGATGGAGGGGCCCGGCAGC
TTCACCATCTTCGCCCCTAGCAACGAGGCCTGGGCCTCCTTGCCAGCTGAAGTGCTGGACTCCCTGGTCAGCAATGT
CAACATTGAGCTGCTCAATGCCCTCCGCTACCATATGGTGGGCAGGCGAGTCCTGACTGATGAGCTGAAACACGGCA
TGACCCTCACCTCTATGTACCAGAATTCCAACATCCAGATCCACCACTATCCTAATGGGATTGTAACTGTGAACTGT
GCCCGGCTCCTGAAAGCCGACCACCATGCAACCAACGGGGTGGTGCACCTCATCGATAAGGTCATCTCCACCATCAC
CAACAACATCCAGCAGATCATTGAGATCGAGGACACCTTTGAGACCCTTCGGGCTGCTGTGGCTGCATCAGGGCTCA
ACACGATGCTTGAAGGTAACGGCCAGTACACGCTTTTGGCCCCGACCAATGAGGCCTTCGAGAAGATCCCTAGTGAG
ACTTTGAACCGTATCCTGGGCGACCCAGAAGCCCTGAGAGACCTGCTGAACAACCACATCTTGAAGTCAGCTATGTG
TGCTGAAGCCATCGTTGCGGGGCTGTCTGTAGAGACCCTGGAGGGCACGACACTGGAGGTGGGCTGCAGCGGGGACA
TGCTCACTATCAACGGGAAGGCGATCATCTCCAATAAAGACATCCTAGCCACCAACGGGGTGATCCACTACATTGAT
GAGCTACTCATCCCAGACTCAGCCAAGACACTATTTGAATTGGCTGCAGAGTCTGATGTGTCCACAGCCATTGACCT
TTTCAGACAAGCCGGCCTCGGCAATCATCTCTCTGGAAGTGAGCGGTTGACCCTCCTGGCTCCCCTGAATTCTGTAT
TCAAAGATGGAACCCCTCCAATTGATGCCCATACAAGGAATTTGCTTCGGAACCACATAATTAAAGACCAGCTGGCC
TCTAAGTATCTGTACCATGGACAGACCCTGGAAACTCTGGGCGGCAAAAAACTGAGAGTTTTTGTTTATCGTAATAG
CCTCTGCATTGAGAACAGCTGCATCGCGGCCCACGACAAGAGGGGGAGGTACGGGACCCTGTTCACGATGGACCGGG
TGCTGACCCCCCCAATGGGGACTGTCATGGATGTCCTGAAGGGAGACAATCGCTTTAGCATGCTGGTAGCTGCCATC
CAGTCTGCAGGACTGACGGAGACCCTCAACCGGGAAGGAGTCTACACAGTCTTTGCTCCCACAAATGAAGCCTTCCG
AGCCCTGCCACCAAGAGAACGGAGCAGACTCTTGGGAGATGCCAAGGAACTTGCCAACATCCTGAAATACCACATTG
GTGATGAAATCCTGGTTAGCGGAGGCATCGGGGCCCTGGTGCGGCTAAAGTCTCTCCAAGGTGACAAGCTGGAAGTC
AGCTTGAAAAACAATGTGGTGAGTGTCAACAAGGAGCCTGTTGCCGAGCCTGACATCATGGCCACAAATGGCGTGGT
CCATGTCATCACCAATGTTCTGCAGCCTCCAGCCAACAGACCTCAGGAAAGAGGGGATGAACTTGCAGACTCTGCGC
TTGAGATCTTCAAACAAGCATCAGCGTTTTCCAGGGCTTCCCAGAGGTCTGTGCGACTAGCCCCTGTCTATCAAAAG
TTATTAGAGAGGATGAAGCATTAGCTTGAAGCACTACAGGAGGAATGCACCACGGCAGCTCTCCGCCAATTTCTCTC
AGATTTCCACAGAGACTGTTTGAATGTTTTCAAAACCAAGTATCACACTTTAATGTACATGGGCCGCACCATAATGA
GATGTGAGCCTTGTGCATGTGGGGGAGGAGGGAGAGAGATGTACTTTTTAAATCATGTTCCCCCTAAACATGGCTGT
TAACCCACTGCATGCAGAAACTTGGATGTCACTGCCTGACATTCACTTCCAGAGAGGACCTATCCCAAATGTGGAAT
TGACTGCCTATGCCAAGTCCCTGGAAAAGGAGCTTCAGTATTGTGGGGCTCATAAAACATGAATCAAGCAATCCAGC
CTCATGGGAAGTCCTGGCACAGTTTTTGTAAAGCCCTTGCACAGCTGGAGAAATGGCATCATTATAAGCTATGAGTT
GAAATGTTCTGTCAAATGTGTCTCACATCTACACGTGGCTTGGAGGCTTTTATGGGGCCCTGTCCAGGTAGAAAAGA
AATGGTATGTAGAGCTTAGATTTCCCTATTGTGACAGAGCCATGGTGTGTTTGTAATAATAAAACCAAAGAAACATAAA

FIGURE 40

GAGTGAGTGAGAGGGCAGAGGAAATACTCAATCTGTGCCACTCACTGCCTTGAGCCTGCTTCCTCACTCCAGGACTG
CCAGAGGCTCACTCCCTTGAGCCTGCTTCCTCACTCCAGGACTGCCAGAGGAAGCAATCACCAAAATGAAGACTGCT
TTAATTTTGCTCAGCATTTTGGGAATGGCCTGTGCTTTCTCAATGAAAAATTTGCATCGAAGAGTCAAAATAGAGGA
TTCTGAAGAAAATGGGGTCTTTAAGTACAGGCCACGATATTATCTTTACAAGCATGCCTACTTTTATCCTCATTTAA
AACGATTTCCAGTTCAGGGCAGTAGTGACTCATCCGAAGAAAATGGAGATGACAGTTCAGAAGAGGAGGAGGAAGAA
GAGGAGACTTCAAATGAAGGAGAAAACAATGAAGAATCGAATGAAGATGAAGACTCTGAGGCTGAGAATACCACACT
TTCTGCTACAACACTGGGCTATGGAGAGGACGCCACGCCTGGCACAGGGTATACAGGGTTAGCTGCAATCCAGCTTC
CCAAGAAGGCTGGGGATATAACAAACAAAGCTACAAAAGAGAAGGAAAGTGATGAAGAAGAAGAGGAGGAAGAGGAA
GGAAATGAAAACGAAGAAAGCGAAGCAGAAGTGGATGAAAACGAACAAGGCATAAACGGCACCAGTACCAACAGCAC
AGAGGCAGAAAACGGCAACGGCAGCAGCGGAGGAGACAATGGAGAAGAAGGGGAAGAAGAAAGTGTCACTGGAGCCA
ATGCAGAAGGCACCACAGAGACCGGAGGGCAGGGCAAGGGCACCTCGAAGACAACAACCTCTCCAAATGGTGGGTTT
GAACCTACAACCCCACCACAAGTCTATAGAACCACTTCCCCACCTTTTGGGAAAACCACCACCGTTGAATACGAGGG
GGAGTACGAATACACGGGCGTCAATGAATACGACAATGGATATGAAATCTATGAAAGTGAGAACGGGGAACCTCGTG
GGGACAATTACCGAGCCTATGAAGATGAGTACAGCTACTTTAAAGGACAAGGCTACGATGGCTATGATGGTCAGAAT
TACTACCACCACCAGTGAAGCTCCAGCCTG

FIGURE 41

GCCAGCCGAGCGGCCAGCCAGTGCGGGGCTGGCCATGTAAGGCCCACAGGCGGTCCTGCCCGCCCGGTGCCCTGCGG
AGAGCCTCGTGCAGCCCTGGGCACCGCCCCTGCCCTGCCCTGACCCCTTGGCCTTGAAATGCTGTCATCGGAGGAGC
CGTCCCGCTCGGGACAAGGCCAGCATGGACAAAGCTAGAGCTGGGGCAAGCAAGGAGCCTTCCTGTCCTCGAGGCCG
TGGGAAGAGAAGCACGCCCAGGGGGCCACTCCTGAGAGCCTCTCTGTCCACCAGGCCTCTGCAGAGGGGTCACCATG
GCTCTGGCCCGAGGCAGCCGGCAGCTGGGGGCCCTGGTGTGGGGCGCCTGCCTGTGCGTGCTGGTGCACGGGCAGCA
GGCGCAGCCCGGGCAGGGCTCGGACCCCGCCCGCTGGCGGCAGCTGATCCAGTGGGAGAACAACGGGCAGGTGTACA
GCTTGCTCAACTCGGGCTCAGAGTACGTGCCGGCCGGACCTCAGCGCTCCGAGAGTAGCTCCCGGGTGCTGCTGGCC
GGCGCGCCCCAGGCCCAGCAGCGGCGCAGCCACGGGAGCCCCCGGCGTCGGCAGGCGCCGTCCCTGCCCCTGCCGGG
GCGCGTGGGCTCGGACACCGTGCGCGGCCAGGCGCGGCACCCATTCGGCTTTGGCCAGGTGCCCGACAACTGGCGCG
AGGTGGCCGTCGGGGACAGCACGGGCATGGCCCTGGCCCGCACCTCCGTCTCCCAGCAACGGCACGGGGGCTCCGCC
TCCTCGGTCTCGGCTTCGGCCTTCGCCAGCACCTACCGCCAGCAGCCCTCCTACCCGCAGCAGTTCCCCTACCCGCA
GGCGCCCTTCGTCAGCCAGTACGAGAACTACGACCCCGCGTCGCGGACCTACGACCAGGGTTTCGTGTACTACCGGC
CCGCGGGCGGCGGCGTGGGCGCGGGGGCGGCGGCCGTGGCCTCGGCGGGGGTCATCTACCCCTACCAGCCCCGGGCG
CGCTACGAGGAGTACGGCGGCGGCGAAGAGCTGCCCGAGTACCCGCCTCAGGGCTTCTACCCGGCCCCCGAGAGGCC
CTACGTGCCGCCGCCGCCGCCGCCCCCCGACGGCCTGGACCGCCGCTACTCGCACAGTCTGTACAGCGAGGGCACCC
CCGGCTTCGAGCAGGCCTACCCTGACCCCGGTCCCGAGGCGGCGCAGGCCCATGGCGGAGACCCACGCCTGGGCTGG
TACCCGCCCTACGCCAACCCGCCGCCCGAGGCGTACGGGCCGCCGCGCGCGCTGGAGCCGCCCTACCTGCCGGTGCG
CAGCTCCGACACGCCCCCGCCGGGTGGGGAGCGGAACGGCGCGCAGCAGGGCCGCCTCAGCGTAGGCAGCGTGTACC
GGCCCAACCAGAACGGCCGCGGTCTCCCTGACTTGGTCCCAGACCCCAACTATGTGCAAGCATCCACTTATGTGCAG
AGAGCCCACCTGTACTCCCTGCGCTGTGCTGCGGAGGAGAAGTGTCTGGCCAGCACAGCCTATGCCCCTGAGGCCAC
CGACTACGATGTGCGGGTGCTACTGCGCTTCCCCCAGCGCGTGAAGAACCAGGGCACAGCAGACTTCCTCCCCAACC
GGCCACGGCACACCTGGGAGTGGCACAGCTGCCACCAGCATTACCACAGCATGGACGAGTTCAGCCACTACGACCTA
CTGGATGCAGCCACAGGCAAGAAGGTGGCCGAGGGCCACAAGGCCAGTTTCTGCCTGGAGGACAGCACCTGTGACTT
CGGCAACCTCAAGCGCTATGCATGCACCTCTCATACCCAGGGCCTGAGCCCAGGCTGCTATGACACCTACAATGCGG
ACATCGACTGCCAGTGGATCGACATAACCGACGTGCAGCCTGGGAACTACATCCTCAAGGTGCACGTGAACCCAAAG
TATATTGTTTTGGAGTCTGACTTCACCAACAACGTGGTGAGATGCAACATTCACTACACAGGTCGCTACGTTTCTGC
AACAAACTGCAAAATTGTCCAATCCTGATCTCCGGGAGGGACAGATGGCCAATCTCTCCCCTTCCAAAGCAGGCCCT
GCTCCCCGGGCAGCCTCCCGCCGAGGGGCCCAGCCCCCAACCCACAGGCAGGGAGGGGCATCCCTCCCTGCCGGCCT
CAGGGAGCGAACGTGGATGAAAACCACAGGGATTCCGGATGCCAGACCCCATTTTATACTTCACTTTTCTCTACAGT
GTTGTTTTGTTGTTGTTGGTTTTTATTTTTTATACTTTGGCCATACCACAGAGCTAGATTGCCCAGGTCTGGGCTGA
ATAAAACAAGGTTTTTCT

FIGURE 42

ACTCCAGCGCGCGGCTACCTACGCTTGGTGCTTGCTTTCTCCAGCCATCGGAGACCAGAGCCGCCCCCTCTGCTCGA
GAAAGGGGCTCAGCGGCGGCGGAAGCGGAGGGGGACCACCGTGGAGAGCGCGGTCCCAGCCCGGCCACTGCGGATCC
CTGAAACCAAAAAGCTCCTGCTGCTTCTGTACCCCGCCTGTCCCTCCCAGCTGCGCAGGGCCCCTTCGTGGGATCAT
CAGCCCGAAGACAGGG<u>ATG</u>GAGAGGCCTCTGTGCTCCCACCTCTGCAGCTGCCTGGCTATGCTGGCCCTCCTGTCCC
CCCTGAGCCTGGCACAGTATGACAGCTGGCCCCATTACCCCGAGTACTTCCAGCAACCGGCTCCTGAGTATCACCAG
CCCCAGGCCCCCGCCAACGTGGCCAAGATTCAGCTGCGCCTGGCTGGGCAGAAGAGGAAGCACAGCGAGGGCCGGGT
GGAGGTGTACTATGATGGCCAGTGGGGCACCGTGTGCGATGACGACTTCTCCATCCACGCTGCCCACGTCGTCTGCC
GGGAGCTGGGCTATGTGGAGGCCAAGTCCTGGACTGCCAGCTCCTCCTACGGCAAGGGAGAAGGGCCCATCTGGTTA
GACAATCTCCACTGTACTGGCAACGAGGCGACCCTTGCAGCATGCACCTCCAATGGCTGGGGCGTCACTGACTGCAA
GCACACGGAGGATGTCGGTGTGGTGTGCAGCGACAAAAGGATTCCTGGGTTCAAATTTGACAATTCGTTGATCAACC
AGATAGAGAACCTGAATATCCAGGTGGAGGACATTCGGATTCGAGCCATCCTCTCAACCTACCGCAAGCGCACCCCA
GTGATGGAGGGCTACGTGGAGGTGAAGGAGGGCAAGACCTGGAAGCAGATCTGTGACAAGCACTGGACGGCCAAGAA
TTCCCGCGTGGTCTGCGGCATGTTTGGCTTCCCTGGGGAGAGGACATACAATACCAAAGTGTACAAAATGTTTGCCT
CACGGAGGAAGCAGCGCTACTGGCCATTCTCCATGGACTGCACCGGCACAGAGGCCCACATCTCCAGCTGCAAGCTG
GGCCCCCAGGTGTCACTGGACCCCATGAAGAATGTCACCTGCGAGAATGGGCTGCCGGCCGTGGTGAGTTGTGTGCC
TGGGCAGGTCTTCAGCCCTGACGGACCCTCGAGATTCCGGAAAGCATACAAGCCAGAGCAACCCCTGGTGCGACTGA
GAGGCGGTGCCTACATCGGGGAGGGCCGCGTGGAGGTGCTCAAAAATGGAGAATGGGGGACCGTCTGCGACGACAAG
TGGGACCTGGTGTCGGCCAGTGTGGTCTGCAGAGAGCTGGGCTTTGGGAGTGCCAAAGAGGCAGTCACTGGCTCCCG
ACTGGGGCAAGGGATCGGACCCATCCACCTCAACGAGATCCAGTGCACAGGCAATGAGAAGTCCATTATAGACTGCA
AGTTCAATGCCGAGTCTCAGGGCTGCAACCACGAGGAGGATGCTGGTGTGAGATGCAACACCCCTGCCATGGGCTTG
CAGAAGAAGCTGCGCCTGAACGGCGGCCGCAATCCCTACGAGGGCCGAGTGGAGGTGCTGGTGGAGAGAAACGGGTC
CCTTGTGTGGGGGATGGTGTGTGGCCAAAACTGGGGCATCGTGGAGGCCATGGTGGTCTGCCGCCAGCTGGGCCTGG
GATTCGCCAGCAACGCCTTCCAGGAGACCTGGTATTGGCACGGAGATGTCAACAGCAACAAAGTGGTCATGAGTGGA
GTGAAGTGCTCGGGAACGGAGCTGTCCCTGGCGCACTGCCGCCACGACGGGGAGGACGTGGCCTGCCCCCAGGGCGG
AGTGCAGTACGGGGCCGGAGTTGCCTGCTCAGAAACCGCCCCTGACCTGGTCCTCAATGCGGAGATGGTGCAGCAGA
CCACCTACCTGGAGGACCGGCCCATGTTCATGCTGCAGTGTGCCATGGAGGAGAACTGCCTCTCGGCCTCAGCCGCG
CAGACCGACCCCACCACGGGCTACCGCCGGCTCCTGCGCTTCTCCTCCCAGATCCACAACAATGGCCAGTCCGACTT
CCGGCCCAAGAACGGCCGCCACGCGTGGATCTGGCACGACTGTCACAGGCACTACCACAGCATGGAGGTGTTCACCC
ACTATGACCTGCTGAACCTCAATGGCACCAAGGTGGCAGAGGGCCACAAGGCCAGCTTCTGCTTGGAGGACACAGAA
TGTGAAGGAGACATCCAGAAGAATTACGAGTGTGCCAACTTCGGCGATCAGGGCATCACCATGGGCTGCTGGGACAT
GTACCGCCATGACATCGACTGCCAGTGGGTTGACATCACTGACGTGCCCCCTGGAGACTACCTGTTCCAGGTTGTTA
TTAACCCCAACTTCGAGGTTGCAGAATCCGATTACTCCAACAACATCATGAAATGCAGGAGCCGCTATGACGGCCAC
CGCATCTGGATGTACAACTGCCACATAGGTGGTTCCTTCAGCGAAGAGACGGAAAAAAAGTTTGAGCACTTCAGCGG
GCTCTTAAACAACCAGCTGTCCCCGCAG<u>TAA</u>AGAAGCCTGCGTGGTCAACTCCTGTCTTCAGGCCACACCACATCTT
CCATGGGACTTCCCCCCAACAACTGAGTCTGAACGAATGCCACGTGCCCTCACCCAGCCCGGCCCCCACCCTGTCCA
GACCCCTACAGCTGTGTCTAAGCTCAGGAGGAAAGGGACCCTCCCATCATTCATGGGGGGCTGCTACCTGACCCTTG
GGGCCTGAGAAGGCCTTGGGGGGGTGGGGTTTGTCCACAGAGCTGCTGGAGCAGCACCAAGAGCCAGTCTTGACCGG
GATGAGGCCCACAGACAGGTTGTCATCAGCTTGTCCCATTCAAGCCACCGAGCTCACCACAGACACAGTGGAGCCGC
GCTCTTCTCCAGTGACACGTGGACAAATGCGGGCTCATCAGCCCCCCCAGAGAGGGTCAGGCCGAACCCCATTTCTC
CTCCTCTTAGGTCATTTTCAGCAAACTTGAATATCTAGACCTCTCTTCCAATGAAACCCTCCAGTCTATTATAGTCA
CATAGATAATGGTGCCACGTGTTTTCTGATTTGGTGAGCTCAGACTTGGTGCTTCCCTCTCCACAACCCCCACCCCT
TGTTTTTCAAGATACTATTATTATATTTTCACAGACTTTTGAAGCACAAATTTATTGGCATTTAATATTGGACATCT
GGGCCCTTGGAAGTACAAATCTAAGGAAAAACCAACCCACTGTGTAAGTGACTCATCTTCCTGTTGTTCCAATTCTG
TGGGTTTTTGATTCAACGGTGCTATAACCAGGGTCCTGGGTGACAGGGCGCTCACTGAGCACCATGTGTCATCACAG
ACACTTACACATACTTGAAACTTGGAATAAAGAAAGATTTATG

FIGURE 43

AGTTTTCATCCAGCCACGGGCCAGCATGTCTGGGGGCAAATACGTAGACTCGGAGGGACATCTCTACACCGTTCCCA
TCCGGGAACAGGGCAACATCTACAAGCCCAACAACAAGGCCATGGCAGACGAGCTGAGCGAGAAGCAAGTGTACGAC
GCGCACACCAAGGAGATCGACCTGGTCAACCGCGACCCTAAACACCTCAACGATGACGTGGTCAAGATTGACTTTGA
AGATGTGATTGCAGAACCAGAAGGGACACACAGTTTTCACGGCATTTGGAAGGCCAGCTTCACCACCTTCACTGTGA
CGAAATACTGGTTTTACCGCTTGCTGTCTGCCCTCTTTGGCATCCCGATGGCACTCATCTGGGGCATTTACTTCGCC
ATTCTCTCTTTCCTGCACATCTGGGCAGTTGTACCATGCATTAAGAGCTTCCTGATTGAGATTCAGTGCACCAGCCG
TGTCTATTCCATCTACGTCCACACCGTCTGTGACCCACTCTTTGAAGCTGTTGGGAAAATATTCAGCAATGTCCGCA
TCAACTTGCAGAAAGAAATATAAATGACATTTCAAGGATAGAAGTATACCTGATTTTTTTTCCTTTTAATTTTCCTG
GTGCCAATTTCAAGTTCCAAGTTGCTAATACAGCAACGAATTTATGAATTGAATTATCTTGGTTGAAAATAAAAAGA
TCACTTTCTCAGTTTTCATAAGTATTATGTCTCTTCTGAGCTATTTCATCTATTTTTGGCAGTCTGAATTTTTAAAA
CCCATTTATATTTCTTTCCTTACCTTTTTATTTGCATGTGGATCAACCATCGCTTTATT

FIGURE 44A

GGCCAGCAGCCAGCTCCCCCGCGCGCCGGACTCTCGGGGCGACACGTGCGGGCCTCCGGCCGCCGAGCGGAGGCGAG
CCGGGCGGAGGCGCGGCGGCCAGGAGCGGCGACCAGGGACCGCAGCGCTGCCCGCGCCCGGCCGGCCGCTCACTCCC
GGCCCGCTCCTCTGCGTCGGCAGCGCCGCGTCGTAGGAGCGCGAGGGCCGCGGCCGGGGATGAGCTGACTGCAGTGA
GAGCGTCGCCCCGGCCCCCGCCAGGCCGCCCGCTGCCATCTCCGCGCCGCCCTGCCAGCCGCGATCATGTCCATCCA
CATCGTGGCGTTGGGGAACGAGGGCGACACGTTCCACCAGGACAACCGGCCGTCGGGGCTCATCCGCACATACCTGG
GAAGAAGCCCGCTGGTGTCGGGGGACGAGAGTAGCTTGTTGCTGAACGCGGCCAGCACGGTCGCGCGCCCGGTGTTC
ACTGAGTACCAGGCCAGTGCGTTCGGGAACGTCAAGCTGGTGGTGCACGACTGTCCCGTCAGGGACATGTCTGATCT
GCGGGCGGCGCCGAGCGAGCCAGCGAACGAGGCCGGGCC<u>ATG</u>GGGCAGCGGGCAGTGGGCTCGTTGCTGCTGGGGCT
GCTGCTGCACGCGCGGCTGCTAGCGGTGACGCATGGGCTGAGGGCCTACGATGGCCTTTCCCTCCCTGAGGACACAG
AGACTGTCACAGCGAGCCGGTATGGCTGGACCTACTCATACCTCTCTGATGATGAGGACCTGCTGGCAGATGATGCA
TCAGGAGATGGCCTTGGCAGCGGAGATGTGGGCAGCGGGGACTTCCAGATGGTCTATTTCCGGGCTCTGGTAAATTT
TACGCGGTCCATTGAGTACAGCCCCCAGCTGGAGGATGCAAGTGCCAAGGAGTTCCGAGAGGTGTCGGAGGCTGTGG
TAGAAAAGCTGGAGCCCGAATACAGGAAGATCCCCGGAGACCAGATTGTCAGTGTGGTGTTCATCAAGGAACTGGAT
GGCTGGGTCTTTGTTGAGCTGGATGTTGGCTCCGAAGGGAATGCGGACGGATCTCAGATTCAAGAGGTGCTGCATAC
AGTGGTCTCCAGTGGCTCCATCGGCCCCTATGTCACCTCCCCCTGGGGGTTCAAGTTCCGACGCCTGGGCACAGTGC
CCCAGTTCCCAAGAGTCTGCACGGAGACGGAGTTTGCTTGCCACAGCTATAATGAGTGTGTGGCTCTGGAGTATCGT
TGTGACCGGAGGCCTGACTGCAGGGACATGTCTGATGAACTCAACTGTGAGGAACCAGTCCCCGAGCTCAGCTCCTC
GACACCTGCTGTGGGGAAGGTGTCACCTTTACCACTCTGGCCAGAAGCAGCCACAACACCTCCACCGCCAGTCACGC
ATGGACCTCAGTTTCTGTTACCCAGTGTTCCTGGGCCCTCAGCCTGTGGGCCCCAGGAGGCCTCGTGCCACAGCGGA
CACTGCATCCCCCGAGACTACCTCTGTGATGGACAGGAAGACTGCAGGGATGGCAGTGACGAACTGGGCTGTGCGTC
CCCTCCACCCTGTGAGCCTAACGAGTTCGCCTGTGAAAATGGGCACTGTGCTCTCAAGTTGTGGCGCTGTGACGGTG
ACTTTGATTGTGAGGACCGGACAGATGAGGCCAATTGTTCTGTCAAGCAGCCTGGAGAAGTATGTGGCCCACGCAC
TTCCAGTGTGTCTCCACCAACCGCTGCATCCCAGCCAGCTTCCACTGTGACGAGGAATCCGACTGTCCCGACCGCAG
TGATGAGTTTGGCTGCATGCCTCCCCAGGTAGTGACGCCTCCACAGCAGTCCATCCAGGCTTCCCGGGGCCAGACAG
TGACTTTCACCTGCGTAGCCACTGGTGTCCCCACACCCATCATCAACTGGAGGCTCAACTGGGGCCACATCCCTGCT
CATCCCAGGGTGACAATGACCAGCGAGGGTGGCGTGGCACGCTGATCATCCGTGACGTGAAGGAGGCAGACCAGGG
CGCATACACCTGTGAGGCCATGAACTCGCGTGGCATGGTGTTCGGCATTCCAGACGGCGTGCTGGAGCTTGTCCCGC
AGCGAGGGCCCTGCCCTGACGGGCACTTCTACCTGGAAGACAGTGCCTCCTGCCTGCCCTGCTTCTGCTTTGGTGTG
ACCAACGTGTGCCAGAGCAGCCTGCGCTTCCGGGACCAGATCCGACTGAGCTTTGACCAGCCCAATGACTTCAAGGG
TGTGAATGTGACGATGCCCTCCCAGCCTGGCGTGCCACCCCTCTCCTCCACCCAGCTGCAGATCGACCCCGCCCTGC
AGGAGTTCCAGCTGGTCGACCTGTCTCGCCGCTTCCTTGTCCACGATGCTTTCTGGGCCCTACCCAAGCAGTTTCTG
GGCAACAAGGTGGACTCCTATGGAGGCTTCCTGCGCTACAAGGTGCGCTATGAACTGGCACGAGGCATGCTGGAGCC
AGTGCAGAAACCAGATGTGATCCTTGTGGGTGCGGGGTACCGCCTACACTCTCGAGGCCACACCCCCACCCATCCTG
GAACTCTGAACCAGCGTCAGGTCCAGCTCTCAGAGGAACACTGGGTCCACGAGTCTGGCCGGCCTGTCCAGCGGGCT
GAGATGCTGCAGGCCCTGGCGAGCCTGGAGGCTGTCCTGCTACAGACAGTATATAACACCAAGATGGCCAGTGTGGG
ACTGAGTGACATTGTCATGGACACCACTGTCACCCATACCACCATCCATGGCCGGGCTCACAGTGTGGAGGAGTGCA
GATGCCCCATTGGCTATTCTGGTTTGTCTTGCGAGAGCTGCGATGCCCACTTCACCCGAGTGCCTGGTGGGCCCTAC
CTGGGTACTTGCTCTGGCTGTAATTGCAATGGCCATGCCAGCTCCTGTGACCCTGTCTACGGCCACTGCCTGAATTG
CCAGCACAACACAGAAGGACCTCAGTGTGACAAGTGTAAGCCTGGCTTCTTTGGAGATGCCACAAAGGCCACAGCCA
CTGCCTGCCGGCCCTGTCCCTGCCCATACATCGACGCTTCCCGAAGGTTCTCAGACACTTGCTTCCTGGACACAGAC
GGCCAAGCCACTTGCGACGCTTGTGCCCCAGGTTACACAGGCCGCCGCTGTGAGAGCTGTGCCCCTGGATATGAAGG
CAACCCCATCCAGCCTGGCGGGAAGTGCAGGCCCACCACCCAGGAAATTGTGCGCTGTGATGAGCGAGGGAGCCTGG
GCACCTCAGGGGAGACTTGCCGCTGTAAGAACAACGTAGTGGGGCGCTTGTGCAACGAGTGCTCGGACGGCTCGTTC
CACCTGAGCAAGCAAAACCCGGACGGCTGCCTCAAGTGCTTTTGCATGGGAGTCAGTCGCCAGTGCAGCAGCTCCTC
CTGGAGCCGCGCCCAGGTGCTCGGGGCCTCGGAACAGCCCTCTCAGTTCAGCCTGAGCAACGCCGCTGGCACCCACA
CCACCAGCGAGGGGGTCTCGTCCCCTGCACCCGGGGAGCTGTCGTTCTCTTCCTTCCACAACCTCCTGTCTGAACCC
TACTTCTGGAGTCTTCCCGCCAGCTTCCGAGGGGACAAGGTGACGTCCTACGGCGGAGAGCTGCGCTTCACTGTGAT
GCAGAGGCCCCGGCCCAGTTCTGCGCCCCTGCACAGACAGCCCCTGGTGGTGTTGCAGGGCAACAACATTGTGTTGG
AGCATCATGCCTCGAGGGATCCCAGCCCTGGCCAGCCCAGCAACTTCATAGTGCCCTTCCAAGAGCAAGCGTGGCAG
CGGCCTGATGGGCAGCCGGCCACACGGGAGCACCTGCTGATGGCCCTCGCAGGCATTGATGCCCTCCTCATCCAAGC
ATCTTACACGCAGCAACCGGCTGAGAGCAGGCTCTCTGGTATCAGCATGGATGTGGCTGTGCCAGAGAACACTGGCC
AGGACTCAGCCCGGGAAGTAGAGCAGTGTACCTGCCCCCCTGGTTACCGCGGCCCTTCCTGCCAGGACTGTGACACA
GGTTACACACGCGTGCCTAGCGGGCTCTACCTGGGCACCTGTGAGCGCTGTAACTGCCATGGCCACTCAGAGACCTG
TGAGCCTGAGACAGGGGCGTGCCAGAGCTGCCAGCACCACACGGAGGGTGCTAGCTGTGAACAGTGCCAGCCAGGGT
ACTATGGGGATGCCCAACGGGGCACACCACAGGACTGCCAGCCCTGCCCATGCTACGGAGCCCCTGCTGCTGGCCAA
GCTGCCCACACTTGTTTCCTGGACACAGATGGCCACCCCACCTGTGACTCATGCTCACCAGGACACAGCGGGCGTCA
CTGTGAGAGGTGTGCCCCAGGTTACTATGGCAACCCCAGCCAGGGCCAGCCCTGCCACAGAGATGGTCAGGTGCCAG
AGGTGCTGGGCTGTGGCTGTGACCCCCATGGCAGCATCAGCAGCCAGTGTGACGCCGCTGGTCAGTGCCAGTGCAAG
GCCCAGGTGGAGGGCCGTTCTTGCAGTCACTGCCGACCTCACCACTTCCACCTGAGTGCCAGCAACCCGGAAGGCTG
CCTGCCCTGTTTCTGCATGGGTGTCACCCAGCAGTGCGCCAGCTCCTCTTACTCCCGCCAGCTGATCTCTACCCACT
TTGCTCCTGGGGACTTCCAAGGCTTTGCTCTGGTGAACCCTCAACGCAACAGCCAACTGACAGGGGGCTTCACCGTG
GAACCAGTGCACGATGGGGCCCGCCTCTCTTTCAGCAACTTTGCCCACCTCGGCCAAGAGTCCTTCTACTGGCAGCT

FIGURE 44B

GCCAGAAATATACCAAGGAGACAAGGTGGCAGCCTATGGCGGGAAGCTGCGGTACACCCTCTCCTACACAGCCGGGC
CACAGGGCAGCCCACTCTTGGACCCTGATATCCAGATTACGGGCAATAACATCATGTTGGTGGCTTCCCAGCCAGCA
CTACAGGGCCCAGAGAGGAGGAGCTATGAGATCATCTTCCGAGAGGAGTTCTGGCGGCGGCCAGATGGACAGCCTGC
GACCCGAGAGCATTTGCTCATGGCCCTGGCAGATCTGGATGAACTTCTGGTGCGGGCCACATTCTCCTCTGTGCCAC
GGGCAGCCAGTATCAGTGCCGTGAGCCTAGAAGGTGCCCAGCCAGGGCCCTCCAGTGGACCCCGAGCCCTCGAGGTG
GAAGAGTGTCGCTGCCCCCCAGGCTATGTTGGCTTGTCCTGCCAGGACTGTGCCCCGGGCTACACTCGCACTGGGAG
CGGACTGTACCTTGGTCAGTGCGAGTTGTGTGAATGCAACGGCCACTCCGACTTGTGTCACCCGGAGACTGGAGCCT
GCTCGCGATGTCAGCACAACACAGCTGGTGAGTTCTGTGAGCTGTGTGCAACTGGTTACTATGGAGATGCCACGGCT
GGGACGCCTGAGGATTGCCAGCCCTGTGCCTGCCCGCTGACCAACCCAGAGAACATGTTCTCCCGCACCTGTGAGAG
CCTTGGAGCTGGAGGGTACCGCTGCACCGCCTGTGAACCTGGCTACACTGGGCAGTACTGTGAGCAGTGTGCCCCAG
GCTATGAAGGTGACCCCAATGTACAAGGAGGCCGGTGCCAGCCACTGACAAAAGAGTCCCTGGAGGTTCAGATCCAT
CCATCTCGGAGCGTGGTTCCCCAAGGCGGCCCACACTCCCTGAGGTGCCAGGTCAGTGGGAGCCCACCACACTACTT
CTACTGGTCCCGTGAAGATGGACGGCCCTTGCCCAGCAGCGCTCAACAGCGGCATCAAGGCTCTGAGCTCCACTTCC
CTAGCGTGCAGCCCTCCGACGCCGGCGTCTACATCTGTACCTGCCGAAACCTGATTCACACGAGCAACAGCAGGGCT
GAGCTACTGGTCGCTGAGGCTCCCAGCAAGCCCATCATGGTGACAGTGGAGGAGCAGCGGAGCCAGAGTGTGCGGCC
CGGAGCTGACGTCACCTTCATCTGTACGGCCAAGAGCAAATCCCCAGCCTACACCCTGGTATGGACCCGTCTGCACA
ACGGGAAGCTGCCGTCCCGTGCTATGGACTTCAATGGCATCCTGACCATTCGCAATGTGCAGCCAAGTGACGCGGGC
ACCTACGTGTGTACTGGCTCCAACATGTTCGCTATGGACCAGGGCACAGCCACACTGCATGTTCAGGTCTCAGGCAC
CTCCACTGCCCCTGTGGCCTCCATACACCCTCCACAGCTCACCGTGCAGCCGGGACAACAGGCTGAGTTCCGCTGTA
GCGCCACGGGGAACCCCACCCCCATGCTGGAATGGATAGGGGGTCCTAGCGGCCAGCTTCCTGCGAAGGCTCAGATC
CACAACGGCATCCTGCGCTTGCCAGCCATTGAACCCTCGGATCAGGGCCAGTACCTGTGCCGTGCCCTCAGCAGCGC
TGGGCAGCATGTGGCCAGGGCTATGCTTCAGGTGCACGGGGGCAGTGGACCCAGGGTCCAGGTTAGCCCCGAGAGGA
CCCAGGTGCATGAAGGCCGCACAGTGAGGCTGTACTGCAGGGCAGCAGGGGTACCCAGTGCCAGCATCACCTGGAGG
AAGGAGGGAGGCAGCCTGCCATTCAGACACCAGGCCCATGGCTCTCGTCTACGGCTACACCACATGTCGGTGGCTGA
CTCCGGCGAGTATGTGTGCCGAGCCAACAACAACATTGATGCCCAGGAGACCTCCATCATGATCTCGGTCTCCCCTA
GCACCAACAGCCCCCCTGCCCCCGCCAGCCCTGCACCCATCAGAATAGAGTCTTCCTCTTCACGTGTGGCCGAAGGA
CAGACCCTGGATCTGAACTGTGTGGTCCCTGGGCACGCCCATGCCCAGGTCACATGGCACAAGCGAGGGGGTAGCCT
GCCCACTCATCATCAGACGCATGGCTCAAGGCTGCGGCTATACCAGGTGTCCTCAGCCGACTCGGGCGAATATGTGT
GCAGCGTTCTGAGCAGCTCTGGCCCTCTGGAGGCTTCCGTCCTGGTCTCGATTACACCAGCTGCCGCTAATGTCCAC
ATCCCTGGTGTAGTCCCGCCCATCCGCATCGAGACTTCCTCCTCCCGAGTGGCTGAGGGGCAGACCCTGGATCTAAG
CTGTGTGGTTCCTGGGCAGGCCCATGCCCAGGTCACATGGCACAAACGTGGAGGCAGCCTGCCCGCTGGGCACCAGG
TCCATGGCCACATGCTGAGACTGAACCGTGTGTCCCCGGCGGACTCTGGCGAGTACTCATGCCAAGTGACGGGCAGC
TCAGGTACCCTGGAGGCTTCTGTCCTGGTCACCATCGAGGCCTCTGAACCCAGCCCTATCCCTGCCCCTGGCCTGGC
CCAGCCTGTCTACATAGAGTCCTCCTCCTCCCATTTGACTGAAGGGCAGACTGTAGATCTGAAGTGCGTGGTACCAG
GGCAAGCCCATGCCCAGGTCACATGGCACAAACGAGGGAGCAGCCTGCCTGCCCGACACCAGACTCATGGCTCCCTG
CTGAGGCTCTACCAGCTCTCCCCTGCTGACTCCGGCGAGTACGTGTGCCAAGTGGCTGGTAGCTCCCACCCTGAGCA
TGAGGCTTCCTTCAAGCTCACAGTACCCTCCAGCCAAAACTCTTCCTTCCGCCTCAGAAGCCCCGTCATCTCCATTG
AACCACCCAGCAGCACGGTACAGCAGGGCCAAGATGCCAGTTTCAAGTGCCTTATTCACGAGGGAGCAATGCCCATC
AAGGTTGAGTGGAAGATTCGGGACCAAGAGCTGGAGGACAACGTCCACATCAGCCCCAACGGCTCCATCATTACCAT
CGTGGCACCCGGCCCAGCAACCATGGAGCCTACCGCTTGCGTGGCTTCCAATGTCTATGGTATGGCCCAGAGTGTCG
TCAATCTCAGCGTGCACGGGCCCCCTACGGTGTCTGTGCTCCCCGAGGGCCCTGTGCATGTGAAGATGGGGAAGGAC
ATCACCCTGGAGTGTATCAGTTCTGGAGAACCGCGCTCTTCCCCTCGTTGGACCCGACTCGGCATCCCTGTCAAGTT
GGAGCCTCGGATGTTTGGGCTCATGAATAGCCACGCGATGCTGAAGATCGCATCCGTGAAACCATCAGACGCAGGCA
CCTACGTGTGCCAAGCCCAGAACGCCCTAGGCACGGCACAGAAGCAGGTGGAGCTGATCGTGGACACTGGCACCGTG
GCCCCGGGGACTCCCCAGGTCCAAGTTGAAGAATCTGAGCTGACCTTGGAGGCTGGCCACACGGCCACTTTACACTG
CTCAGCCACGGGCAACCCCCCACCCACCATCCACTGGTCCAAGCTGCGCGCCCCACTGCCCTGGCAGCACCGGATAG
AAGGCAACACACTGGTCATTCCCCGGGTGGCCCAGCAGGACTCAGGACAGTACATCTGTAACGCCACCAACTCTGCT
GGGCACACTGAAGCCACCGTTGTCCTGCATGTGGAGAGTCCTCCATATGCCACCATAATTCCAGAACATACCTCGGC
GCAGCCAGGGAACCTGGTTCAGCTGCAGTGCCTGGCTCACGGCACGCCCCCGCTCACCTACCAGTGGAGCCTTGTGG
GCGGCGTCCTCCCCGAGAAGGCGGTTGTCAGGAACCAGCTGCTGCGCCTGGAGCCCACAGTCCCCGAAGACTCTGGC
CGCTACCGCTGCCAGGTCTCCAACAGGGTGGGCTCCGCGGAGGCCTTTGCTCAAGTCCTGGTCCAAGGCTCCTCTAG
CAATCTCCCTGACACTTCCATCCCAGGAGGATCCACACCCACTGTGCAAGTCACTCCTCAGCTAGAGACCCGGAACA
TAGGGGCCAGCGTTGAGTTCCACTGTGCTGTGCCCAATGAGCGTGGCACCCACCTTCGCTGGCTCAAGGAGGGCGGT
CAGCTGCCTCCTGGACACAGTGTACAAGATGGAGTCCTCAGAATCCAGAACTTAGACCAGAACTGCCAAGGGACATA
TGTCTGTCAGGCCCATGGGCCTTGGGGACAAGCCCAGGCCACTGCCCAGCTGATCGTTCAAGCCTTGCCCTCCGTGC
TCATCAACGTCCGAACCTCTGTGCACTCTGTGGTAGTCGGCCACTCTGTGGAGTTTGAGTGCTTGGCCCTGGGTGAC
CCTAAGCCTCAGGTGACATGGAGCAAAGTCGGGGGACACCTACGGCCTGGCATCGTGCAAAGCGGAACGATCATCAG
GATTGCCCACGTGGAGCTGGCTGATGCAGGACAGTACCGCTGTGCAGCTACCAACGCTGCGGGCACCACCCAGTCCC
ACGTGCTGCTGCTAGTACAAGCCTTGCCCCAGATCTCAACTCCCCCGGAGATCCGAGTGCCTGCCGGTTCTGCGGCT
GTCTTCCCGTGCATGGCCTCAGGCTACCCGACGCCTGCCATCACCTGGAGTAAGGTGGACGGTGATCTGCCACCTGA
CAGTCGCCTGGAAAACAATATGCTGATGCTACCATCAGTTCGCCCCGAGGATGCCGGCACCTACGTGTGCACTGCCA
CCAACCGGCAGGGCAAGGTCAAAGCCTTTGCCTATCTGCAGGTGCCAGAGCGAGTGATACCCTACTTCACCCAGACA
CCCTACTCCTTCCTGCCACTTCCCACCATCAAAGATGCCTACAGGAAGTTTGAGATCAAGATCACCTTCCGGCCAGA

FIGURE 44C

CTCTGCGGATGGGATGCTGCTGTACAATGGGCAGAAGCGGAGTCCCACCAACCTAGCCAACAGACAGCCGGATTTCA
TCTCCTTTGGCCTCGTGGGCGGAAGGCCTGAGTTTCGATTTGATGCCGGCTCTGGCATGGCCACTATCCGCCACCCC
ACACCTCTGGCTCTAGGCCAGTTCCACACCGTGACCCTGTTACGAAGCCTCACTCAAGGATCTCTGATTGTGGGCAA
TTTGGCCCCTGTCAACGGGACCTCCCAGGGCAAGTTCCAAGGTTTAGACCTGAACGAGGAGCTGTATCTGGGTGGCT
ACCCTGACTACGGTGCCATCCCCAAGGCTGGGCTGAGTAGCGGCTTTGTAGGCTGTGTACGTGAGCTGCGTATCCAA
GGCGAGGAGATTGTCTTCCATGACGTCAACCTCACAACACATGGCATCTCCCACTGCCCTACTTGCCAGGACCGACC
CTGCCAGAATGGGGGCCAGTGCCAAGATTCTGAGAGCAGCAGTTACACGTGTGTCTGCCCTGCTGGCTTCACGGCAG
CCGCTGTGAACATTCGCAAGCCCTGCACTGCCACCCCGAGCCTGTGGGCCGACGCCACTTGTGTGAACCGGCCAGAC
GGTCGAGGCTACACCTGTCGCTGCCACCTGGGCCGCTCCGGGGTGAGGTGTGAAGAAGGTGTAACGGTGACCACCCC
ATCGATGTCTGGTGCTGGTTCCTACCTGGCACTACCGGCTCTCACCAACACGCACCATGAGCTACGCCTGGATGTGG
AGTTCAAGCCGCTGGAACCCAATGGGATCTTACTGTTCAGTGGGGGCAAGAGCGGGCCTGTGGAAGACTTTGTGTCC
CTAGCAATGGTTGGTGGCCACCTGGAGTTCCGCTATGAGTTAGGGTCAGGTCTGGCTGTTCTGCGGAGCCACGAGCC
ACTGGCCTTAGGACGGTGGCACCGAGTGTCTGCGGAACGCCTGAACAAAGATGGCAGCCTGCGGGTGGATGGAGGGC
GTCCTGTGTTACGCTCTTCACCAGGAAAGAGCCAGGGCCTTAACCTGCATACCCTGCTCTACCTGGGTGGTGTGGAG
CCCTCGGTACAGCTGTCCCCAGCCACCAATATGAGTGCTCACTTCCATGGCTGTGTGGGTGAGGTATCTGTGAATGG
CAAGCGGTTGGACCTCACCTACAGCTTCTTGGGCAGCCAGGGTGTGGGCCAGTGCTACGACAGCTCCCCGTGCGAGC
GCCAGCCCTGCCGGAATGGCGCCACGTGCATGCCTGCGGGCGAATATGAGTTCCAGTGCCTCTGTCAAGATGGCTTC
AAAGGAGACCTTTGTGAACATGAGGAGAACCCGTGCCAGCTGCATGAACCATGTCTGAATGGTGGCACCTGCCGGGG
TGCCCGATGCCTCTGTCTGCCTGGCTTCTCTGGTCCACGCTGCCAACAAGGCGCTGGATATGGGGTAGTGGAGTCAG
ACTGGCACCCTGAAGGCAGTGGAGGCAATGATGCCCCTGGGCAATACGGAGCCTACTTTTATGACAATGGTTTCCTA
GGCCTCCCTGGTAACAGTTTCTCAAGGAGCCTGCCTGAAGTACCCGAGACCATTGAATTCGAGGTTCGGACCAGCAC
AGCCGATGGCCTCCTGCTCTGGCAGGGTGTGGTGAGAGAGGCCAGCCGCAGCAAGGACTTCATTAGCCTTGGACTAC
AGGATGGCCATCTAGTGTTCAGCTACCAACTGGGCAGTGGGGAGGCCCGTCTTGTCTCAGGAGATCCCATCAATGAC
GGCGAGTGGCATCGGATAACAGCGCTGCGAGAGGGCCAGAGAGGCTCCATCCAAGTAGACGGTGAGGATCTGGTCAC
TGGCCGGTCCCCAGGTCCTAATGTGGCGGTCAACACCAAGGACATCATCTACATTGGTGGTGCCCCAGATGTGGCCA
CACTGACCAGGGGCAAGTTCTCTTCTGGGATCACAGGCTGTATCAAGAATCTGGTGTTGCACACGGCCCGGCCTGGA
GCCCCACCTCCACAGCCCCTGGACCTGCAGCATCGCGCCCAGGCAGGGGCCAACACACGGCCCTGCCCCTCATAGGC
ACCCACCTGCCTCCCACGGACTCCTGGGAAGCACCCAGCCTGACAGTGTCGAGTATATTATTATTAATATTATTATG
ACTTTTTGTAAGAGACTGAGGCAAGGCCACGCTTCGCTGCTACCACCCTGGGCTGGACTGGAGGGTGGGTGCGCCAA
CTCCCACGCATTCGTGGGCAGAGCCGAGGCTGATGGGCAGGACAAGGGGATTGGAAGAGGTTTCTCAGAAGGCTCCG
GAACTTGGAGTCAGGCATCGTGACTGGTAGGGCTCAGAACTGTTCCCATCCCTTTCCCTGCTTCAGCGTCAGGCTGG
GCCACCCACTTCAGCAGGCCGTGCGTGCGGACAGTCCTCATTGCTGTGAGCGCCACGCTCAGTTACCACCTGGTGCC
TCACTGTCAAACTGAACGAGGGGGTGTGGCCATGGCTGAGCCACTGTTCTGGGAGCAGAAGGCAGCTCACTGCCCCC
CCCCACACACACACACACACCGACCACATACCATCCCAGCCTCCTCCACACCCACCTAGCCAGAGGTCCCATGTCCT
TGGCAGTGTCCCCTCCCACCCAGCCCTCCTCCACCTGCATTCCCCCACCCCTACCCCCATACCCCCCCCACACACAC
ACACACAGCCCAGCTCTGCCCTCAGAGCTGCAAGGGAGACCAACTCTTTCCCAGAATCGCTAGCAGAGCCCAGCCCA
CCACACCAGGCCACACCCCCCCACTCTTCTGGAGGTGAAGGCCCAGGGCGTGGGGAGCAGGGATCCGGAGCACCTG
TGGCTTGGTGGAGGCAGCTGAGACCTCAGCTTGGGAAGGGGAACGAGGGATGATGATAACCCTGCCCATCTGGGAGC
CTGAGGACCTGACTAAGGGGTAAGCAGGCCCAGACTGTGGCTCTTGGGTCCTAGAGGGAACCCCCTGTGGTCTTTCT
CTGATTTTTTTTTTCTTAATAAACGGTGCTATCCCCGCT

FIGURE 45

CAAGAAGACCCACACGCCCCCCTCCAGCAGCTGAATTCCTGCAGCTCAGCAGCCGCCGCCAGAGCAGGACGAACCGC
CAATCGCAAGGCACCTCTGAGAACTTCAGGATGCAGATGTCTCCAGCCCTCACCTGCCTAGTCCTGGGCCTGGCCCT
TGTCTTTGGTGAAGGGTCTGCTGTGCACCATCCCCCATCCTACGTGGCCCACCTGGCCTCAGACTTCGGGGTGAGGG
TGTTTCAGCAGGTGGCGCAGGCCTCCAAGGACCGCAACGTGGTTTTCTCACCCTATGGGGTGGCCTCGGTGTTGGCC
ATGCTCCAGCTGACAACAGGAGGAGAAACCCAGCAGCAGATTCAAGCAGCTATGGGATTCAAGATTGATGACAAGGG
CATGGCCCCCGCCCTCCGGCATCTGTACAAGGAGCTCATGGGGCCATGGAACAAGGATGAGATCAGCACCACAGACG
CGATCTTCGTCCAGCGGGATCTGAAGCTGGTCCAGGGCTTCATGCCCCACTTCTTCAGGCTGTTCCGGAGCACGGTC
AAGCAAGTGGACTTTTCAGAGGTGGAGAGAGCCAGATTCATCATCAATGACTGGGTGAAGACACACACAAAAGGTAT
GATCAGCAACTTGCTTGGGAAAGGAGCCGTGGACCAGCTGACACGGCTGGTGCTGGTGAATGCCCTCTACTTCAACG
GCCAGTGGAAGACTCCCTTCCCCGACTCCAGCACCCACCGCCGCCTCTTCCACAAATCAGACGGCAGCACTGTCTCT
GTGCCCATGATGGCTCAGACCAACAAGTTCAACTATACTGAGTTCACCACGCCCGATGGCCATTACTACGACATCCT
GGAACTGCCCTACCACGGGGACACCCTCAGCATGTTCATTGCTGCCCCTTATGAAAAAGAGGTGCCTCTCTCTGCCC
TCACCAACATTCTGAGTGCCCAGCTCATCAGCCACTGGAAAGGCAACATGACCAGGCTGCCCCGCCTCCTGGTTCTG
CCCAAGTTCTCCCTGGAGACTGAAGTCGACCTCAGGAAGCCCCTAGAGAACCTGGGAATGACCGACATGTTCAGACA
GTTTCAGGCTGACTTCACGAGTCTTTCAGACCAAGAGCCTCTCCACGTCGCGCAGGCGCTGCAGAAAGTGAAGATCG
AGGTGAACGAGAGTGGCACGGTGGCCTCCTCATCCACAGCTGTCATAGTCTCAGCCCGCATGGCCCCCGAGGAGATC
ATCATGGACAGACCCTTCCTCTTTGTGGTCCGGCACAACCCCACAGGAACAGTCCTTTTCATGGGCCAAGTGATGGA
ACCCTGACCCTGGGGAAAGACGCCTTCATCTGGGACAAAACTGGAGATGCATCGGGAAAGAAGAAACTCCGAAGAAA
AGAATTTTAGTGTTAATGACTCTTTCTGAAGGAAGAGAAGACATTTGCCTTTTGTTAAAAGATGGTAAACCAGATCT
GTCTCCAAGACCTTGGCCTCTCCTTGGAGGACCTTTAGGTCAAACTCCCTAGTCTCCACCTGAGACCCTGGGAGAGA
AGTTTGAAGCACAACTCCCTTAAGGTCTCCAAACCAGACGGTGACGCCTGCGGGACCATCTGGGGCACCTGCTTCCA
CCCGTCTCTCTGCCCACTCGGGTCTGCAGACCTGGTTCCCACTGAGGCCCTTTGCAGGACGGAACTACGGGGCTTAC
AGGAGCTTTTGTGTGCCTGGTAGAAACTATTTCTGTTCCAGTCACATTGCCATCACTCTTGTACTGCCTGCCACCGC
GGAGGAGGCTGGTGACAGGCCAAAGGCCAGTGGAAGAAACACCCTTTCATCTCAGAGTCCACTGTGGCACTGGCCAC
CCCTCCCCAGTACAGGGGTGCTGCAGGTGGCAGAGTGAATGTCCCCCATCATGTGGCCCAACTCTCCTGGCCTGGCC
ATCTCCCTCCCCAGAAACAGTGTGCATGGGTTATTTTGGAGTGTAGGTGACTTGTTTACTCATTGAAGCAGATTTCT
GCTCCCTTTTATTTTTATAGGAATAGAGGAAGAAAGGTCAGATGCGTGCCCAGCTCTTCACCCCCCAATCTCTTGGT
GGGGAGGGGTGTACCTAAATATTTATCATATCCTTGCCCTTGAGTGCTTGTTAGAGAGAAAGAGAACTACTAAGGAA
AATAATATTATTTAAACTCGC

FIGURE 46

CTAACCCAGAAACATCCAATTCTCAAACTGAAGCTCGCACTCTCGCCTCCAGCATGAAAGTCTCTGCCGCCCTTCTG
TGCCTGCTGCTCATAGCAGCCACCTTCATTCCCCAAGGGCTCGCTCAGCCAGATGCAATCAATGCCCCAGTCACCTG
CTGTTATAACTTCACCAATAGGAAGATCTCAGTGCAGAGGCTCGCGAGCTATAGAAGAATCACCAGCAGCAAGTGTC
CCAAAGAAGCTGTGATCTTCAAGACCATTGTGGCCAAGGAGATCTGTGCTGACCCCAAGCAGAAGTGGGTTCAGGAT
TCCATGGACCACCTGGACAAGCAAACCCAAACTCCGAAGACTTGAACACTCACTCCACAACCCAAGAATCTGCAGCT
AACTTATTTTCCCCTAGCTTTCCCCAGACACCCTGTTTTATTTTATTATAATGAATTTTGTTTGTTGATGTGAAACA
TTATGCCTTAAGTAATGTTAATTCTTATTTAAGTTATTGATGTTTTAAGTTTATCTTTCATGGTACTAGTGTTTTTT
AGATACAGAGACTTGGGGAAATTGCTTTTCCTCTTGAACCACAGTTCTACCCCTGGGATGTTTTGAGGGTCTTTGCA
AGAATCATTAATACAAAGAATTTTTTTTAACATTCCAATGCATTGCTAAAATATTATTGTGGAAATGAATATTTTGT
AACTATTACACCAAATAAATATATTTTTGTAC

FIGURE 47

GCCAGGGGAAGAGGGTGATCCGACCCGGGGAAGGTCGCTGGGCAGGGCGAGTTGGGAAAGCGGCAGCCCCCGCCGCC
CCCGCAGCCCCTTCTCCTCCTTTCTCCCACGTCCTATCTGCCTCTCGCTGGAGGCCAGGCCGTGCAGCATCGAAGAC
AGGAGGAACTGGAGCCTCATTGGCCGGCCCGGGGCGCCGGCCTCGGGCTTAAATAGGAGCTCCGGGCTCTGGCTGGG
ACCCGACCGCTGCCGGCCGCGCTCCCGCTGCTCCTGCCGGGTGATGGAAAACCCCAGCCCGGCCGCCGCCCTGGGCA
AGGCCCTCTGCGCTCTCCTCCTGGCCACTCTCGGCGCCGCCGGCCAGCCTCTTGGGGGAGAGTCCATCTGTTCCGCC
AGAGCCCCGGCCAAATACAGCATCACCTTCACGGGCAAGTGGAGCCAGACGGCCTTCCCCAAGCAGTACCCCCTGTT
CCGCCCCCCTGCGCAGTGGTCTTCGCTGCTGGGGGCCGCGCATAGCTCCGACTACAGCATGTGGAGGAAGAACCAGT
ACGTCAGTAACGGGCTGCGCGACTTTGCGGAGCGCGGCGAGGCCTGGGCGCTGATGAAGGAGATCGAGGCGGCGGGG
GAGGCGCTGCAGAGCGTGCACGAGGTGTTTTCGGCGCCCGCCGTCCCCAGCGGCACCGGGCAGACGTCGGCGGAGCT
GGAGGTGCAGCGCAGGCACTCGCTGGTCTCGTTTGTGGTGCGCATCGTGCCCAGCCCCGACTGGTTCGTGGGCGTGG
ACAGCCTGGACCTGTGCGACGGGGACCGTTGGCGGGAACAGGCGGCGCTGGACCTGTACCCCTACGACGCCGGGACG
GACAGCGGCTTCACCTTCTCCTCCCCCAACTTCGCCACCATCCCGCAGGACACGGTGACCGAGATAACGTCCTCCTC
TCCCAGCCACCCGGCCAACTCCTTCTACTACCCGCGGCTGAAGGCCCTGCCTCCCATCGCCAGGGTGACACTGCTGC
GGCTGCGACAGAGCCCCAGGGCCTTCATCCCTCCCGCCCCAGTCCTGCCCAGCAGGGACAATGAGATTGTAGACAGC
GCCTCAGTTCCAGAAACGCCGCTGGACTGCGAGGTCTCCCTGTGGTCGTCCTGGGGACTGTGCGGAGGCCACTGTGG
GAGGCTCGGGACCAAGAGCAGGACTCGCTACGTCCGGGTCCAGCCCGCCAACAACGGGAGCCCCTGCCCCGAGCTCG
AAGAAGAGGCTGAGTGCGTCCCTGATAACTGCGTCTAAGACCAGAGCCCCGCAGCCCCTGGGGCCCCCCGGAGCCAT
GGGGTGTCGGGGGCTCCTGTGCAGGCTCATGCTGCAGGCGGCCGAGGGCACAGGGGGTTTCGCGCTGCTCCTGACCG
CGGTGAGGCCGCGCCGACCATCTCTGCACTGAAGGGCCCTCTGGTGGCCGGCACGGGCATTGGGAAACAGCCTCCTC
CTTTCCCAACCTTGCTTCTTAGGGGCCCCCGTGTCCCGTCTGCTCTCAGCCTCCTCCTCCTGCAGGATAAAGTCATC
CCCAAGGCTCCAGCTACTCTAAATTATGTCTCCTTATAAGTTATTGCTGCTCCAGGAGATTGTCCTTCATCGTCCAG
GGGCCTGGCTCCCACGTGGTTGCAGATACCTCAGACCTGGTGCTCTAGGCTGTGCTGAGCCCACTCTCCCGAGGGCG
CATCCAAGCGGGGGCCACTTGAGAAGTGAATAAATGGGGCGGTTTCGGAAGCGTCAGTGTTTCCATGTTATGGATCT
CTCTGCGTTTGAATAAAGACTATCTCTGTTGCTCACAAAAAAAAAAAAAAAAAAAAAAAAAAAAAAAAAAAAAAAAAA

FIGURE 48

ACTTGCGTCTCGCCCTCCGGCCAAGCATGGGGCTTCCCAGGCTGGTCTGCGCCTTCTTGCTCGCCGCCTGCTGCTGC
TGTCCTCGCGTCGCGGGTGTGCCCGGAGAGGCTGAGCAGCCTGCGCCTGAGCTGGTGGAGGTGGAAGTGGGCAGCAC
AGCCCTTCTGAAGTGCGGCCTCTCCCAGTCCCAAGGCAACCTCAGCCATGTCGACTGGTTTTCTGTCCACAAGGAGA
AGCGGACGCTCATCTTCCGTGTGCGCCAGGGCCAGGGCCAGAGCGAACCTGGGGAGTACGAGCAGCGGCTCAGCCTC
CAGGACAGAGGGGCTACTCTGGCCCTGACTCAAGTCACCCCCCAAGACGAGCGCATCTTCTTGTGCCAGGGCAAGCG
CCCTCGGTCCCAGGAGTACCGCATCCAGCTCCGCGTCTACAAAGCTCCGGAGGAGCCAAACATCCAGGTCAACCCCC
TGGGCATCCCTGTGAACAGTAAGGAGCCTGAGGAGGTCGCTACCTGTGTAGGGAGGAACGGGTACCCCATTCCTCAA
GTCATCTGGTACAAGAATGGCCGGCCTCTGAAGGAGGAGAAGAACCGGGTCCACATTCAGTCGTCCCAGACTGTGGA
GTCGAGTGGTTTGTACACCTTGCAGAGTATTCTGAAGGCACAGCTGGTTAAAGAAGACAAAGATGCCCAGTTTTACT
GTGAGCTCAACTACCGGCTGCCCAGTGGGAACCACATGAAGGAGTCCAGGGAAGTCACCGTCCCTGTTTTCTACCCG
ACAGAAAAAGTGTGGCTGGAAGTGGAGCCCGTGGGAATGCTGAAGGAAGGGGACCGCGTGGAAATCAGGTGTTTGGC
TGATGGCAACCCTCCACCACACTTCAGCATCAGCAAGCAGAACCCCAGCACCAGGGAGGCAGAGGAAGAGACAACCA
ACGACAACGGGGTCCTGGTGCTGGAGCCTGCCCGGAAGGAACACAGTGGGCGCTATGAATGTCAGGCCTGGAACTTG
GACACCATGATATCGCTGCTGAGTGAACCACAGGAACTACTGGTGAACTATGTGTCTGACGTCCGAGTGAGTCCCGC
AGCCCCTGAGAGACAGGAAGGCAGCAGCCTCACCCTGACCTGTGAGGCAGAGAGTAGCCAGGACCTCGAGTTCCAGT
GGCTGAGAGAAGAGACAGACCAGGTGCTGGAAAGGGGGCCTGTGCTTCAGTTGCATGACCTGAAACGGGAGGCAGGA
GGCGGCTATCGCTGCGTGGCGTCTGTGCCCAGCATACCCGGCCTGAACCGCACACAGCTGGTCAAGCTGGCCATTTT
TGGCCCCCCTTGGATGGCATTCAAGGAGAGGAAGGTGTGGGTGAAAGAGAATATGGTGTTGAATCTGTCTTGTGAAG
CGTCAGGGCACCCCCGGCCCACCATCTCCTGGAACGTCAACGGCACGGCAAGTGAACAAGACCAAGATCCACAGCGA
GTCCTGAGCACCCTGAATGTCCTCGTGACCCCGGAGCTGTTGGAGACAGGTGTTGAATGCACGGCCTCCAACGACCT
GGGCAAAAACACCAGCATCCTCTTCCTGGAGCTGGTCAATTTAACCACCCTCACACCAGACTCCAACACAACCACTG
GCCTCAGCACTTCCACTGCCAGTCCTCATACCAGAGCCAACAGCACCTCCACAGAGAGAAAGCTGCCGGAGCCGGAG
AGCCGGGGCGTGGTCATCGTGGCTGTGATTGTGTGCATCCTGGTCCTGGCGGTGCTGGGCGCTGTCCTCTATTTCCT
CTATAAGAAGGGCAAGCTGCCGTGCAGGCGCTCAGGGAAGCAGGAGATCACGCTGCCCCCGTCTCGTAAGACCGAAC
TTGTAGTTGAAGTTAAGTCAGATAAGCTCCCAGAAGAGATGGCCTCCTGCAGGGCAGCAGCGGTGACAAGAGGGCT
CCGGGAGACCAGGGAGAGAAATACATCGATCTGAGGCATTAGCCCCGAATCACTTCAGCTCCCTTCCCTGCCTGGAC
CATTCCCAGCTCCCTGCTCACTCTTCTCTCAGCCAAAGCCTCCAAAGGGACTAGAGAGAAGCCTCCTGCTCCCCTCA
CCTGCACACCCCCTTTCAGAGGGCCACTGGGTTAGGACCTGAGGACCTCACTTGGCCCTGCAAGCCGCTTTTCAGGG
ACCAGTCCACCACCATCTCCTCCACGTTGAGTGAAGCTCATCCCAAGCAAGGAGCCCCAGTCTCCCGAGCGGGTAGG
AGAGTTTCTTGCAGAACGTGTTTTTTCTTTACACACATTATGGCTGTAAATACCTGGCTCCTGCCAGCAGCTGAGCT
GGGTAGCCTCTCTGAGCTGGTTTCCTGCCCCAAAGGCTGGCTTCCACCATCCAGGTGCACCACTGAAGTGAGGACAC
ACCGGAGCCAGGCGCCTGCTCATGTTGAAGTGCGCTGTTCACACCCGCTCCGGAGAGCACCCCAGCGGCATCCAGAA
GCAGCTGCAGTGTTGCTGCCACCACCCTCCTGCTCGCCTCTTCAAAGTCTCCTGTGACATTTTTTCTTTGGTCAGAA
GCCAGGAACTGGTGTCATTCCTTAAAAGATACGTGCCGGGGCCAGGTGTGGTGGCTCACGCCTGTAATCCCAGCACT
TTGGGAGGCCGAGGCGGGCGGATCACAAAGTCAGGACGAGACCATCCTGGCTAACACGGTGAAACCCTGTCTCTACT
AAAAATACAAAAAAAAATTAGCTAGGCGTAGTGGTTGGCACCTATAGTCCCAGCTACTCGGAAGGCTGAAGCAGGAG
AATGGTATGAATCCAGGAGGTGGAGCTTGCAGTGAGCCGAGACCGTGCCACTGCACTCCAGCCTGGGCAACACAGCG
AGACTCCGTCTCGAGGAAAAAAAAAGAAAAGACGCGTACCTGCGGTGAGGAAGCTGGGCGCTGTTTTCGAGTTCAGG
TGAATTAGCCTCAATCCCCGTGTTCACTTGCTCCCATAGCCCTCTTGATGGATCACGTAAAACTGAAAGGCAGCGGG
GAGCAGACAAAGATGAGGTCTACACTGTCCTTCATGGGGATTAAAGCTATGGTTATATTAGCACCAAACTTCTACAA
ACCAAGCTCAGGGCCCCAACCCTAGAAGGGCCCAAATGAGAGAATGGTACTTAGGGATGGAAAACGGGGCCTGGCTA
GAGCTTCGGGTGTGTGTGTCTGTCTGTGTGTATGCATACATATGTGTGTATATATGGTTTTGTCAGGTGTGTAAATT
TGCAAATTGTTTCCTTTATATATGTATGTATATATATATATGAAAATATATATATATATGAAAAATAAAGCTTAATT
GTCCCAGAAAATCATACATTGCTTTTTTATTCTACATGGGTACCACAGGAACCTGGGGGCCTGTGAAACTACAACCA
AAAGGCACACAAAACCGTTTCCAGTTGGCAGCAGAGATCAGGGGTTACCTCTGCTTCTGAGCAAATGGCTCAAGCTC
TACCAGAGCAGACAGCTACCCTACTTTTCAGCAGCAAAACGTCCCGTATGACGCAGCACGAAGGGCCTGGCAGGCTG
TTAGCAGGAGCTATGTCCCTTCCTATCGTTTCCGTCCACTT

FIGURE 49A

GCCGGGGCGGGACGCGTTGTGCAGCGGGTAAGCGCACGGCCGAGCGAGCATGGAGGGGGACCGGGTGGCCGGGCGGC
CGGTGCTGTCGTCGTTACCAGTGCTACTGCTGCTGCAGTTGCTAATGTTGCGGGCCGCGGCGCTGCACCCAGACGAG
CTCTTCCCACACGGGGAGTCGTGGGGGGACCAGCTCCTGCAGGAAGGCGACGACGAAAGCTCAGCCGTGGTGAAGCT
GGCGAATCCCCTGCACTTCTACGAAGCCCGATTCAGCAACCTCTACGTGGGCACCAACGGCATCATCTCCACTCAGG
ACTTCCCCAGGGAAACGCAGTATGTGGACTATGATTTCCCCACCGACTTCCCGGCCATCGCCCCTTTTCTGGCGGAC
ATCGACACGAGCCACGGCAGAGGCCGAGTCCTGTACCGAGAGGACACCTCCCCCGCAGTGCTGGGCCTGGCCGCCCG
CTATGTGCGCGCTGGCTTCCCGCGCTCTGCGCGCTTTACCCCCACCCACGCCTTCCTGGCCACCTGGGAGCAGGTAG
GCGCTTACGAGGAGGTCAAGCGCGGGGCGCTGCCCTCGGGAGAGCTGAACACTTTCCAGGCAGTTTTGGCATCTGAT
GGGTCTGATAGCTACGCCCTCTTTCTTTATCCTGCCAACGGCCTGCAGTTCCTTGGAACCCGCCCCAAAGAGTCTTA
CAATGTCCAGCTTCAGCTTCCAGCTCGGGTGGGCTTCTGCCGAGGGGAGGCTGATGATCTGAAGTCAGAAGGACCAT
ATTTCAGCTTGACTAGCACTGAACAGTCTGTGAAAAATCTCTATCAACTAAGCAACCTGGGGATCCCTGGAGTGTGG
GCTTTCCATATCGGCAGCACTTCCCCGTTGGACAATGTCAGGCCAGCTGCAGTTGGAGACCTTTCCGCTGCCCACTC
TTCTGTTCCCCTGGGACGTTCCTTCAGCCATGCTACAGCCCTGGAAAGTGACTATAATGAGGACATTTTGGATTACT
ACGATGTGAATGAGGAGGAAGCTGAATACCTTCCGGGTGAACCAGAGGAGGCATTGAATGGCCACAGCAGCATTGAT
GTTTCCTTCCAATCCAAAGTGGATACAAAGCCTTTAGAGGAATCTTCCACCTTGGATCCTCACACCAAAGAAGGAAC
ATCTCTGGGAGAGGTAGGGGGCCCAGATTTAAAAGGCCAAGTTGAGCCCTGGGATGAGAGAGAGACCAGAAGCCCAG
CTCCACCAGAGGTAGACAGAGATTCACTGGCTCCTTCCTGGGAAACCCCACCACCGTACCCCGAAAACGGAAGCATC
CAGCCCTACCCAGATGGAGGGCCAGTGCCTTCGGAAATGGATGTTCCCCCAGCTCATCCTGAAGAAGAAATTGTTCT
TCGAAGTTACCCTGCTTCAGATCACACTACACCCTTAAGTCGAGGGACGTATGAGGTGGGACTGGAAGACAACATAG
GTTCCAACACCGAGGTCTTCACGTATAATGCTGCCAACAAGGAAACCTGTGAACACAACCACAGACAATGCTCCCGG
CATGCCTTCTGCACGGACTATGCCACTGGCTTCTGCTGCCACTGCCAATCCAAGTTTTATGGAAATGGGAAGCACTG
TCTGCCTGAAGGGGCACCTCACCGAGTGAATGGGAAAGTGAGTGGCCACCTCCACGTGGGCCATACACCCGTGCACT
TCACTGATGTGGACCTGCATGCGTATATCGTGGGCAATGATGGCAGAGCCTACACGGCCATCAGCCACATCCCACAG
CCAGCAGCCCAGGCCCTCCTCCCCCTCACACCAATTGGAGGCCTGTTTGGCTGGCTCTTTGCTTTAGAAAAACCTGG
CTCTGAGAACGGCTTCAGCCTCGCAGGTGCTGCCTTTACCCATGACATGGAAGTTACATTCTACCCGGGAGAGGAGA
CGGTTCGTATCACTCAAACTGCTGAGGGACTTGACCCAGAGAACTACCTGAGCATTAAGACCAACATTCAAGGCCAG
GTGCCTTACGTCCCAGCAAATTTCACAGCCCACATCTCTCCCTACAAGGAGCTGTACCACTACTCCGACTCCACTGT
GACCTCTACAAGTTCCAGAGACTACTCTCTGACTTTTGGTGCAATCAACCAAACATGGTCCTACCGCATCCACCAGA
ACATCACTTACCAGGTGTGCAGGCACGCCCCCAGACACCCGTCCTTCCCCACCACCCAGCAGCTGAACGTGGACCGG
GTCTTTGCCTTGTATAATGACGAAGAAAGAGTGCTTAGATTTGCTGTGACCAATCAAATTGGCCCGGTCAAAGAAGA
TTCAGACCCCACTCCGGTGAATCCTTGCTATGATGGGAGCCACATGTGTGACACAACAGCACGGTGCCATCCAGGGA
CAGGTGTAGATTACACCTGTGAGTGCGCATCTGGGTACCAGGGAGATGGACGGAACTGTGTGGATGAAAATGAATGT
GCAACTGGCTTTCATCGCTGTGGCCCCAACTCTGTATGTATCAACTTGCCTGGAAGCTACAGGTGTGAGTGCCGGAG
TGGTTATGAGTTTGCAGATGACCGGCATACTTGCATCTTGATCACCCCACCTGCCAACCCCTGTGAGGATGGCAGTC
ATACCTGTGCTCCTGCTGGGCAGGCCCGGTGTGTTCACCATGGAGGCAGCACGTTCAGCTGTGCCTGCCTGCCTGGT
TATGCCGGCGATGGGCACCAGTGCACTGATGTAGATGAATGCTCAGAAAACAGATGTCACCCTGCAGCTACCTGCTA
CAATACTCCTGGTTCCTTCTCCTGCCGTTGTCAACCCGGATATTATGGGGATGGATTTCAGTGCATACCTGACTCCA
CCTCAAGCCTGACACCCTGTGAACAACAGCAGCGCCATGCCCAGGCCCAGTATGCCTACCCTGGGGCCCGGTTCCAC
ATCCCCCAATGCGACGAGCAGGGCAACTTCCTGCCCCTACAGTGTCATGGCAGCACTGGTTTCTGCTGGTGCGTGGA
CCCTGATGGTCATGAAGTTCCTGGTACCCAGACTCCACCTGGCTCCACCCCGCCTCACTGTGGACCATCACCAGAGC
CCACCCAGAGGCCCCCGACCATCTGTGAGCGCTGGAGGGAAAACCTGCTGGAGCACTACGGTGGCACCCCCCGGGAT
GACCAGTACGTGCCCCAGTGCGATGACCTGGGCCACTTCATCCCCCTGCAGTGCCACGGAAAGAGCGACTTCTGCTG
GTGTGTGGACAAAGATGGCAGAGAGGTGCAGGGCACCCGCTCCCAGCCAGGCACCACCCCTGCGTGTATACCCACCG
TCGCTCCACCCATGGTCCGGCCCACGCCCCGGCCAGATGTGACCCCTCCATCTGTGGGCACCTTCCTGCTCTATACT
CAGGGCCAGCAGATTGGCTACTTACCCCTCAATGGCACCAGGCTTCAGAAGGATGCAGCTAAGACCCTGCTGTCTCT
GCATGGCTCCATAATCGTGGGAATTGATTACGACTGCCGGGAGAGGATGGTGTACTGGACAGATGTTGCTGGACGGA
CAATCAGCCGTGCTGGTCTGGAACTGGGAGCAGAGCCTGAGACGATCGTGAATTCAGGTCTGATAAGCCCTGAAGGA
CTTGCCATAGACCACATCCGCAGAACAATGTACTGGACGGACAGTGTCCTGGATAAGATAGAGAGCGCCCTGCTGGA
TGGCTCTGAGCGCAAGGTCCTCTTCTACACAGATCTGGTGAATCCCCGTGCCATCGCTGTGGATCCAATCCGAGGCA
ACTTGTACTGGACAGACTGGAATAGAGAAGCTCCTAAAATTGAAACGTCATCTTTAGATGGAGAAAACAGAAGAATT
CTGATCAATACAGACATTGGATTGCCCAATGGCTTAACCTTTGACCCTTTCTCTAAACTGCTCTGCTGGGCAGATGC
AGGAACCAAAAAACTGGAGTGTACACTACCTGATGGAACTGGACGGCGTGTCATTCAAAACAACCTCAAGTACCCCT
TCAGCATCGTAAGCTATGCAGATCACTTCTACCACACAGACTGGAGGAGGGATGGTGTTGTATCAGTAAATAAACAT
AGTGGCCAGTTTACTGATGAGTATCTCCCAGAACAACGATCTCACCTCTACGGGATAACTGCAGTCTACCCCTACTG
CCCAACAGGAAGAAAGTAAGTACAGTAATGTAAAGGAAGACTTGGAGTTTACAATCAGAACCTGGACCCTAAAGAAC
AGTGACTGCAAAGGCAAAGAAAGTAAAAAAGGAATTGGCCATTAGACGTTCCTGAGCATCCAAGATGAACATTTTGT
AGTGCAAAAAGACTTTTGTGAAAAGCTGATACCTCAATCTTTACTACTGTATTTTTAAAAATGAAGGTTGTTATTGC
AAGTTTAAAAAGGTAACAGAATTTTAACTGTTGCTTATTAAAGCAACTTCTTGTAAACATTTATCATTAATATTTAA
AAGATCAAATTCATTCAACTAAGAATTAGAGTTTAAGACTCTAAACCTGATTTTTGCCATGGATTCCTTCTGGCCAA
GAAATTAAAGCACATGTGATCAATATAACAATATAATCCTAAACCTTGACAGTTGGAGAAGCCAATGCAGAACTGAT
GGGAAAGGACCAATTATTTATAGTTTCCCAACAAAAGTTCTAAGATTTTTTACCTCTGCATCAGTGCATTTCTATTT
ATATCAAAAGGTGCTAAAATGATTCAATTTGCATTTTCTGATCCTGTAGTGCCTCTATAGAAGTACCCACAGAAAGT

FIGURE 49B

AAAGTATCACATTTATAAATACCAAAGATGTAACAATTTTAAAATTTTCTAGATTACTCCAATAAAGTGTTTTAAGT
TTTCCTATGAAAAAAAA

FIGURE 50

GACTCCTAGGGGCTTGCAGACCTAGTGGGAGAGAAAGAACATCGCAGCAGCCAGGCAGAACCAGGACAGGTGAGGTG
CAGGCTGGCTTTCCTCTCGCAGCGCGGTGTGGAGTCCTGTCCTGCCTCAGGGCTTTTCGGAGCCTGGATCCTCAAGG
AACAAGTAGACCTGGCCGCGGGGAGTGGGGAGGGAAGGGGTGTCTATTGGGCAACAGGGCGGCAAAGCCCTGAATAA
AGGGGCGCAGGGCAGGCGCAAGTGCAGAGCCTTCGTTTGCCAAGTCGCCTCCAGACCGCAGACATGAAACTTGTCTT
CCTCGTCCTGCTGTTCCTCGGGGCCCTCGGACTGTGTCTGGCTGGCCGTAGGAGAAGGAGTGTTCAGTGGTGCGCCG
TATCCCAACCCGAGGCCACAAAATGCTTCCAATGGCAAAGGAATATGAGAAAAGTGCGTGGCCCTCCTGTCAGCTGC
ATAAAGAGAGACTCCCCCATCCAGTGTATCCAGGCCATTGCGGAAAACAGGGCCGATGCTGTGACCCTTGATGGTGG
TTTCATATACGAGGCAGGCCTGGCCCCCTACAAACTGCGACCTGTAGCGGCGGAAGTCTACGGGACCGAAAGACAGC
CACGAACTCACTATTATGCCGTGGCTGTGGTGAAGAAGGGCGGCAGCTTTCAGCTGAACGAACTGCAAGGTCTGAAG
TCCTGCCACACAGGCCTTCGCAGGACCGCTGGATGGAATGTCCCTACAGGGACACTTCGTCCATTCTTGAATTGGAC
GGGTCCACCTGAGCCCATTGAGGCAGCTGTGGCCAGGTTCTTCTCAGCCAGCTGTGTTCCCGGTGCAGATAAAGGAC
AGTTCCCCAACCTGTGTCGCCTGTGTGCGGGGACAGGGGAAAACAAATGTGCCTTCTCCTCCCAGGAACCGTACTTC
AGCTACTCTGGTGCCTTCAAGTGTCTGAGAGACGGGGCTGGAGACGTGGCTTTTATCAGAGAGAGCACAGTGTTTGA
GGACCTGTCAGACGAGGCTGAAAGGGACGAGTATGAGTTACTCTGCCCAGACAACACTCGGAAGCCAGTGGACAAGT
TCAAAGACTGCCATCTGGCCCGGGTCCCTTCTCATGCCGTTGTGGCACGAAGTGTGAATGGCAAGGAGGATGCCATC
TGGAATCTTCTCCGCCAGGCACAGGAAAAGTTTGGAAAGGACAAGTCACCGAAATTCCAGCTCTTTGGCTCCCCTAG
TGGGCAGAAAGATCTGCTGTTCAAGGACTCTGCCATTGGGTTTTCGAGGGTGCCCCCGAGGATAGATTCTGGGCTGT
ACCTTGGCTCCGGCTACTTCACTGCCATCCAGAACTTGAGGAAAAGTGAGGAGGAAGTGGCTGCCCGGCGTGCGCGG
GTCGTGTGGTGTGCGGTGGGCGAGCAGGAGCTGCGCAAGTGTAACCAGTGGAGTGGCTTGAGCGAAGGCAGCGTGAC
CTGCTCCTCGGCCTCCACCACAGAGGACTGCATCGCCCTGGTGCTGAAAGGAGAAGCTGATGCCATGAGTTTGGATG
GAGGATATGTGTACACTGCATGCAAATGTGGTTTGGTGCCTGTCCTGGCAGAGAACTACAAATCCCAACAAAGCAGT
GACCCTGATCCTAACTGTGTGGATAGACCTGTGGAAGGATATCTTGCTGTGGCGGTGGTTAGGAGATCAGACACTAG
CCTTACCTGGAACTCTGTGAAAGGCAAGAAGTCCTGCCACACCGCCGTGGACAGGACTGCAGGCTGGAATATCCCCA
TGGGCCTGCTCTTCAACCAGACGGGCTCCTGCAAATTTGATGAATATTTCAGTCAAAGCTGTGCCCCTGGGTCTGAC
CCGAGATCTAATCTCTGTGCTCTGTGTATTGGCGACGAGCAGGGTGAGAATAAGTGCGTGCCCAACAGCAACGAGAG
ATACTACGGCTACACTGGGGCTTTCCGGTGCCTGGCTGAGAATGCTGGAGACGTTGCATTTGTGAAAGATGTCACTG
TCTTGCAGAACACTGATGGAAATAACAATGAGGCATGGGCTAAGGATTTGAAGCTGGCAGACTTTGCGCTGCTGTGC
CTCGATGGCAAACGGAAGCCTGTGACTGAGGCTAGAAGCTGCCATCTTGCCATGGCCCCGAATCATGCCGTGGTGTC
TCGGATGGATAAGGTGGAACGCCTGAAACAGGTGCTGCTCCACCAACAGGCTAAATTTGGGAGAAATGGATCTGACT
GCCCGGACAAGTTTTGCTTATTCCAGTCTGAAACCAAAAACCTTCTGTTCAATGACAACACTGAGTGTCTGGCCAGA
CTCCATGGCAAAACAACATATGAAAAATATTTGGGACCACAGTATGTCGCAGGCATTACTAATCTGAAAAAGTGCTC
AACCTCCCCCCTCCTGGAAGCCTGTGAATTCCTCAGGAAGTAAAACCGAAGAAGATGGCCCAGCTCCCCAAGAAAGC
CTCAGCCATTCACTGCCCCCAGCTCTTCTCCCCAGGTGTGTTGGGGCCTTGGCTCCCCTGCTGAAGGTGGGGATTGC
CCATCCATCTGCTTACAATTCCCTGCTGTCGTCTTAGCAAGAAGTAAAATGAGAAATTTTGTTGATATTCAAAAAAAA

FIGURE 51A

GCGCACTCGGGCACGCGCTCGGAAGTCGGGGGTCGGCGCGGAGTGCAGGCTGCTCCCGGGGTAGGTGAGGGAAGCGC
GGAGGCGGGGCGCGGGGGCAGTGGTCGGCGAGCAGCGCGGTCCTCGCTAGGGGCGCCCACCCGTCAGTCTCTCCGGC
GCGAGCCGCCGCCACCGCCCGCGCCGGAGTCAGGCCCCTGGGCCCCCAGGCTCAAGCAGCGAAGCGGCCTCCGGGGG
ACGCCGCTAGGCGAGAGGAACGCGCCGGTGCCCTTGCCTTCGCCGTGACCCAGCGTGCGGGCGGCGGG<u>ATG</u>AGAGGG
AGCCATCGGGCCGCGCCGGCCCTGCGGCCCCGGGGGCGGCTCTGGCCCGTGCTGGCCGTGCTGGCGGCGGCCGCCGC
GGCGGGCTGTGCCCAGGCAGCCATGGACGAGTGCACGGACGAGGGCGGGCGGCCGCAGCGCTGCATGCCCGAGTTCG
TCAACGCCGCTTTCAACGTGACTGTGGTGGCCACCAACACGTGTGGGACTCCGCCCGAGGAATACTGTGTGCAGACC
GGGGTGACCGGGGTCACCAAGTCCTGTCACCTGTGCGACGCCGGGCAGCCCCACCTGCAGCACGGGGCAGCCTTCCT
GACCGACTACAACAACCAGGCCGACACCACCTGGTGGCAAAGCCAGACCATGCTGGCCGGGGTGCAGTACCCCAGCT
CCATCAACCTCACGCTGCACCTGGGAAAAGCTTTTGACATCACCTATGTGCGTCTCAAGTTCCACACCAGCCGCCCG
GAGAGCTTTGCCATTTACAAGCGCACACGGGAAGACGGGCCCTGGATTCCTTACCAGTACTACAGTGGTTCCTGCGA
GAACACCTACTCCAAGGCAAACCGCGGCTTCATCAGGACAGGAGGGGACGAGCAGCAGGCCTTGTGTACTGATGAAT
TCAGTGACATTTCTCCCCTCACTGGGGGCAACGTGGCCTTTTCTACCCTGGAAGGAAGGCCCAGCGCCTATAACTTT
GACAATAGCCCTGTGCTGCAGGAATGGGTAACTGCCACTGACATCAGAGTAACTCTTAATCGCCTGAACACTTTTGG
AGATGAAGTGTTTAACGATCCCAAAGTTCTCAAGTCCTATTATTATGCCATCTCTGATTTTGCTGTAGGTGGCAGAT
GTAAATGTAATGGACACGCAAGCGAGTGTATGAAGAACGAATTTGATAAGCTGGTGTGTAATTGCAAACATAACACA
TATGGAGTAGACTGTGAAAAGTGTCTTCCTTTCTTCAATGACCGGCCGTGGAGGAGGGCAACTGCGGAAAGTGCCAG
TGAATGCCTGCCCTGTGATTGCAATGGTCGATCCCAGGAATGCTACTTCGACCCTGAACTCTATCGTTCCACTGGCC
ATGGGGGCCACTGTACCAACTGCCAGGATAACACAGATGGCGCCCACTGTGAGAGGTGCCGAGAGAACTTCTTCCGC
CTTGGCAACAATGAAGCCTGCTCTTCATGCCACTGTAGTCCTGTGGGCTCTCTAAGCACACAGTGTGATAGTTACGG
CAGATGCAGCTGTAAGCCAGGAGTGATGGGGGACAAATGTGACCGTTGCCAGCCTGGATTCCATTCTCTCACTGAAG
CAGGATGCAGGCCATGCTCTTGTGATCCCTCTGGCAGCATAGATGAATGTAATGTTGAAACAGGAAGATGTGTTTGC
AAAGACAATGTCGAAGGCTTCAATTGTGAAAGATGCAAACCTGGATTTTTTAATCTGGAATCATCTAATCCTCGGGG
TTGCACACCCTGCTTCTGCTTTGGGCATTCTTCTGTCTGTACAAACGCTGTTGGCTACAGTGTTTATTCTATCTCCT
CTACCTTTCAGATTGATGAGGATGGGTGGCGTGCGGAACAGAGAGATGGCTCTGAAGCATCTCTCGAGTGGTCCTCT
GAGAGGCAAGATATCGCCGTGATCTCAGACAGCTACTTTCCTCGGTACTTCATTGCTCCTGCAAAGTTCTTGGGCAA
GCAGGTGTTGAGTTATGGTCAGAACCTCTCCTTCTCCTTTCGAGTGGACAGGCGAGATACTCGCCTCTCTGCCGAAG
ACCTTGTGCTTGAGGGAGCTGGCTTAAGAGTATCTGTACCCTTGATCGCTCAGGGCAATTCCTATCCAAGTGAGACC
ACTGTGAAGTATGTCTTCAGGCTCCATGAAGCAACAGATTACCCTTGGAGGCCTGCTCTTACCCCTTTTGAATTTCA
GAAGCTCCTAAACAACTTGACCTCTATCAAGATACGTGGGACATACAGTGAGAGAAGTGCTGGATATTTGGATGATG
TCACCCTGGCAAGTGCTCGTCCTGGGCCTGGAGTCCCTGCAACTTGGGTGGAGTCCTGCACCTGTCCTGTGGGATAT
GGAGGGCAGTTTTGTGAGATGTGCCTCTCAGGTTACAGAAGAGAAACTCCTAATCTTGGACCATACAGTCCATGTGT
GCTTTGCGCCTGCAATGGACACAGCGAGACCTGTGATCCTGAGACAGGTGTTTGTAACTGCAGAGACAATACGGCTG
GCCCGCACTGTGAGAAGTGCAGTGATGGGTACTATGGAGATTCAACTGCAGGCACCTCCTCCGATTGCCAACCCTGT
CCGTGTCCTGGAGGTTCAAGTTGTGCTGTTGTTCCCAAGACAAAGGAGGTGGTGTGCACCAACTGTCCTACTGGCAC
CACTGGTAAGAGATGTGAGCTCTGTGATGATGGCTACTTTGGAGACCCCCTGGGTAGAAACGGCCCTGTGAGACTTT
GCCGCCTGTGCCAGTGCAGTGACAACATCGATCCCAACGCAGTTGGAAATTGCAATCGCTTGACGGGAGAATGCCTG
AAGTGCATCTATAACACTGCTGGCTTCTATTGTGACCGGTGCAAAGACGGATTTTTTGGAAATCCCCTGGCTCCCAA
TCCAGCAGACAAATGCAAAGCCTGCAATTGCAATCCGTATGGGACCATGAAGCAGCAGAGCAGCTGTAACCCCGTGA
CGGGGCAGTGTGAATGTTTGCCTCACGTGACTGGCCAGGACTGTGGTGCTTGTGACCCTGGATTCTACAATCTGCAG
AGTGGGCAAGGCTGTGAGAGGTGTGACTGCCATGCCTTGGGCTCCACCAATGGGCAGTGTGACATCCGCACCGGCCA
GTGTGAGTGCCAGCCCGGCATCACTGGTCAGCACTGTGAGCGCTGTGAGGTCAACCACTTTGGGTTTGGACCTGAAG
GCTGCAAACCCTGTGACTGTCATCCTGAGGGATCTCTTTCACTTCAGTGCAAAGATGATGGTCGCTGTGAATGCAGA
GAAGGCTTTGTGGGAAATCGCTGTGACCAGTGTGAAGAAAACTATTTCTACAATCGGTCTTGGCCTGGCTGCCAGGA
ATGTCCAGCTTGTTACCGGCTGGTAAAGGATAAGGTTGCTGATCATAGAGTGAAGCTCCAGGAATTAGAGAGTCTCA
TAGCAAACCTTGGAACTGGGGATGAGATGGTGACAGATCAAGCCTTCGAGGATAGACTAAAGGAAGCAGAGAGGGAA
GTTATGGACCTCCTTCGTGAGGCCCAGGATGTCAAAGATGTTGACCAGAATTTGATGGATCGCCTACAGAGAGTGAA
TAACACTCTGTCCAGCCAAATTAGCCGTTTACAGAATATCCGGAATACCATTGAAGAGACTGGAAACTTGGCTGAAC
AAGCGCGTGCCCATGTAGAGAACACAGAGCGGTTGATTGAAATCGCATCCAGAGAACTTGAGAAAGCAAAAGTCGCT
GCTGCCAATGTGTCAGTCACTCAGCCAGAATCTACAGGGGACCCAAACAACATGACTCTTTTGGCAGAAGAGGCTCG
AAAGCTTGCTGAACGTCATAAACAGGAAGCTGATGACATTGTTCGAGTGGCAAAGACAGCCAATGATACGTCAACTG
AGGCATACAACCTGCTTCTGAGGACACTGGCAGGAGAAAATCAAACAGCATTTGAGATTGAAGAGCTTAATAGGAAG
TATGAACAAGCGAAGAACATCTCACAGGATCTGGAAAAACAAGCTGCCCGAGTACATGAGGAGGCCAAAAGGGCCGG
TGACAAAGCTGTGGAGATCTATGCCAGCGTGGCTCAGCTGAGCCCTTTGGACTCTGAGACACTGGAGAATGAAGCAA
ATAACATAAAGATGGAAGCTGAGAATCTGGAACAACTGATTGACCAGAAATTAAAAGATTATGAGGACCTCAGAGAA
GATATGAGAGGGAAGGAACTTGAAGTCAAGAACCTTCTGGAGAAAGGCAAGACTGAACAGCAGACCGCAGACCAACT
CCTAGCCCGAGCTGATGCTGCCAAGGCCCTCGCTGAAGAAGCTGCAAAGAAGGGACGGGATACCTTACAAGAAGCTA
ATGACATTCTCAACAACCTGAAAGATTTTGATAGGCGCGTGAACGATAACAAGACGGCCGCAGAGGAGGCACTAAGG
AAGATTCCTGCCATCAACCAGACCATCACTGAAGCCAATGAAAAGACCAGAGAAGCCCAGCAGGCCCTGGGCAGTGC
TGCGGCGGATGCCACAGAGGCCAAGAACAAGGCCCATGAGGCGGAGAGGATCGCAAGCGCTGTCCAAAAGAATGCCA
CCAGCACCAAGGCAGAAGCTGAAAGAACTTTTGCAGAAGTTACAGATCTGGATAATGAGGTGAACAATATGTTGAAG
CAACTGCAGGAAGCAGAAAAAGAGCTAAAGAGAAAACAAGATGACGCTGACCAGGACATGATGATGGCAGGGATGGC

FIGURE 51B

TTCACAGGCTGCTCAAGAAGCCGAGATCAATGCCAGAAAAGCCAAAAACTCTGTTACTAGCCTCCTCAGCATTATTA
ATGACCTCTTGGAGCAGCTGGGGCAGCTGGATACAGTGGACCTGAATAAGCTAAACGAGATTGAAGGCACCCTAAAC
AAAGCCAAAGATGAAATGAAGGTCAGCGATCTTGATAGGAAAGTGTCTGACCTGGAGAATGAAGCCAAGAAGCAGGA
GGCTGCCATCATGGACTATAACCGAGATATCGAGGAGATCATGAAGGACATTCGCAATCTGGAGGACATCAGGAAGA
CCTTACCATCTGGCTGCTTCAACACCCCGTCCATTGAAAAGCCC<u>TAG</u>TGTCTTTAGGGCTGGAAGGCAGCATCCCTC
TGACAGGGGGGCAGTTGTGAGGCCACAGAGTGCCTTGACACAAAGATTACATTTTTCAGACCCCCACTCCTCTGCTG
CTGTCCATCACTGTCCTTTTGAACCAGGAAAAGTCACAGAGTTTAAAGAGAAGCAAATTAAACATCCTGAATCGGGA
ACAAAGGGTTTTATCTAATAAAGTGTCTCTTCCATCACGTTGCTACCTTACCCACACTTCCCTCTGATTTGCGTGAG
GACGTGGCATCCTACTTACGTACGTGGCATAACACATCGTGTGAGCCCATGTATGCTGGGGTAGAGCAAGTAGCCCT
CCCCTGTCTCATCGATCCAGCAGAACCTCCTCAGTCTCAGTACTCTTGTTTCTATAAGGAAAAGTTTTGCTACTAAC
AGTAGCATTGTGATGGCCAGTATATCCAGTCCATGGATAAAGAAAATGCATCTGCATCTCCTGCCCCTCTTCCTTCT
AAGCAAAAGGAAATAAACATCCTGTGCCAAAGGTATTGGTCATTTAGAATGTCGGTAGCCATCCATCAGTGCTTTTA
GCTATTATGAGTGTAGGACACTGAGCCATCCGTGGGTCAGGATGCAATTATTTATAAAGTCCCCAGGTGAACATGG
CTGAAGATTTTTCTAGTATATTAATAATTGACTAGGAAGATGAACTTTTTTTCAGATCTTTGGGCAGCTGATAATTT
AAATCTGGATGGGCAGCTTGCACTCACCAATAGACCAAAAGACATCTTTTGATATTCTTATAAATGGAACTTACACA
GAAGAAATAGGGATATGATAACCACTAAAGTTTTGTTTTCAAAATCAAACTAATTCTTACAGCTTTTTTATTAGTTA
GTCTTGGAACTAGTGTTAAGTATCTGGCAGAGAACAGTTAATCCCTAAGGTCTTGACAAAACAGAAGAAAAACAAGC
CTCCTCGTCCTAGTCTTTTCTAGCAAAGGGATAAAACTTAGATGGCAGCTTGTACTGTCAGAATCCCGTGTATCCAT
TTGTTCTTCTGTTGGAGAGATGAGACATTTGACCCTTAGCTCCAGTTTTCTTCTGATGTTTCCATCTTCCAGAATCC
CTCAAAAAACATTGTTTGCCAAATCCTGGTGGCAAATACTTGCACTCAGTATTTCACACAGCTGCCAACGCTATCGA
GTTCCTGCACTTTGTGATTTAAATCCACTCTAAACCTTCCCTCTAAGTGTAGAGGGAAGACCCTTACGTGGAGTTTC
CTAGTGGGCTTCTCAACTTTTGATCCTCAGCTCTGTGGTTTTAAGACCACAGTGTGACAGTTCCCTGCCACACACCC
CCTTCCTCCTACCAACCCACCTTTGAGATTCATATATAGCCTTTAACACTATGCAACTTTGTACTTTGCGTAGCAGG
GGCTGGGGTGGGGGAAAGAAACCTATTATCATGGACACACTGGTGCTATTAATTATTTCAAATTTATATTTTTGTG
TGAATGTTTTGTGTTTTGTTTATCCATGCTATAGAACAAGGAATTTATGTAGATATACTTAGTCCTATTTCTAGAAT
GACACTCTGTTCACTTTGCTCAATTTTTCCTCTTCACTGGCACAAGTATCTGAATACCTCCTTCCCTCCCTTCTAGA
GTTCTTTGGATTGTACTCCAAAGAATTGTGCCTTGTGTTTGCAGCATCTCCATTCTCTAAATTAATATAATTGCTTT
CCTCCACACCCAGCCACGTAAAGAGGTAACTTGGGTCCTCTTCCATTGCAGTCCTGATGATCCTAACCTGCAGCACG
GTGGTTTTACAATGTTCCAGAGCAGGAACGCCAGGTTGACAAGCTATGGTAGGATTAGGAAAGTTTGCTGAAGAGGA
TCTTTGACGCCACAGTGGGACTAGCCAGGAATGAGGGAGAAATGCCCTTTTTGGCAATTGTTGGAGCTGGATAGGTA
AGTTTTATAAGGGAGTACATTTTGACTGAGCACTTAGGGCATCAGGAACAGTGCTACTTACTGGTGGGTAGACTGGG
AGAGGTGGTGTAACTTAGTTCTTGATGATCCCACTTCCTGTTTCCATCTGCTTGGGATATACCAGAGTTTACCACAA
GTGTTTTGACGATATACTCCTGAGCTTTCACTCTGCTGGCTTCTCCCAGGCCTCTTCTACTATGGCAGGAGATGTGG
TGTGCTGTTGCAAAGTTTTCACGTCATCGTTTCCTGGCTAGTTCATTTCATTAAGTGGCTACATCCTAACATATGCA
TTGGTCAAGGTTGCAGCAAGAGGACTGAAGATTGACTGCCAAGCTAGTTTGGGTGAAGTTCACTCCAGCAAGTCTCA
GGCCACAATGGGGTGGTTTGGTTTGGTTTCCTTTTAACTTTCTTTTTGTTATTTGCTTTTCTCCTCCACCTGTGTGG
TATATTTTTTAAGCAGAATTTTATTTTTTAAAATAAAAGGTTCTTTACAAGATGATACCTTAATTACACTCCCGCAA
CACAGCCATTATTTTATTGTCTAGCTCCAGTTATCTGTATTTTATGTAATGTAATTGACAGGATGGCTGCTGCAGAA
TGCTGGTTGACACAGGGATTATTATACTGCTATTTTTCCCTGAATTCTTTTCCTTGGAATTCCAACTGTGGACCTTT
TATATGTGCCTTCACTTTAGCTGTTTGCCTTACTCTACAGCCTTGCTCTCCGGGGTGGTTAATAAAATGCAACACTT
GGCATTTTTATGTTATAAGAAAAACAGTATTTTATTTATAATAAAATCTGAATATTTTGTAACCCTTTA

FIGURE 52A

GAAGAGCAAGAGGCAGGCTCAGCAAATGGTTCAGCCCCAGTCCCCGGTGGCTGTCAGTCAAAGCAAGCCCGGTTGTT
ATGACAATGGAAAACACTATCAGATAAATCAACAGTGGGAGCGGACCTACCTAGGTAATGTGTTGGTTTGTACTTGT
TATGGAGGAAGCCGAGGTTTTAACTGCGAAAGTAAACCTGAAGCTGAAGAGACTTGCTTTGACAAGTACACTGGGAA
CACTTACCGAGTGGGTGACACTTATGAGCGTCCTAAAGACTCCATGATCTGGGACTGTACCTGCATCGGGGCTGGGC
GAGGGAGAATAAGCTGTACCATCGCAAACCGCTGCCATGAAGGGGGTCAGTCCTACAAGATTGGTGACACCTGGAGG
AGACCACATGAGACTGGTGGTTACATGTTAGAGTGTGTGTGTCTTGGTAATGGAAAAGGAGAATGGACCTGCAAGCC
CATAGCTGAGAAGTGTTTTGATCATGCTGCTGGGACTTCCTATGTGGTCGGAGAAACGTGGGAGAAGCCCTACCAAG
GCTGGATGATGGTAGATTGTACTTGCCTGGGAGAAGGCAGCGGACGCATCACTTGCACTTCTAGAAATAGATGCAAC
GATCAGGACACAAGGACATCCTATAGAATTGGAGACACCTGGAGCAAGAAGGATAATCGAGGAAACCTGCTCCAGTG
CATCTGCACAGGCAACGGCCGAGGAGAGTGGAAGTGTGAGAGGCACACCTCTGTGCAGACCACATCGAGCGGATCTG
GCCCCTTCACCGATGTTCGTGCAGCTGTTTACCAACCGCAGCCTCACCCCCAGCCTCCTCCCTATGGCCACTGTGTC
ACAGACAGTGGTGTGGTCTACTCTGTGGGGATGCAGTGGTTGAAGACACAAGGAAATAAGCAAATGCTTTGCACGTG
CCTGGGCAACGGAGTCAGCTGCCAAGAGACAGCTGTAACCCAGACTTACGGTGGCAACTTAAATGGAGAGCCATGTG
TCTTACCATTCACCTACAATGGCAGGACGTTCTACTCCTGCACCACGGAAGGGCGACAGGACGGACATCTTTGGTGC
AGCACAACTTCGAATTATGAGCAGGACCAGAAATACTCTTTCTGCACAGACCACACTGTTTTGGTTCAGACTCAAGG
AGGAAATTCCAATGGTGCCTTGTGCCACTTCCCCTTCCTATACAACAACCACAATTACACTGATTGCACTTCTGAGG
GCAGAAGAGACAACATGAAGTGGTGTGGGACCACACAGAACTATGATGCCGACCAGAAGTTTGGGTTCTGCCCCATG
GCTGCCCACGAGGAAATCTGCACAACCAATGAAGGGGTCATGTACCGCATTGGAGATCAGTGGGATAAGCAGCATGA
CATGGGTCACATGATGAGGTGCACGTGTGTTGGGAATGGTCGTGGGGAATGGACATGCATTGCCTACTCGCAACTTC
GAGATCAGTGCATTGTTGATGACATCACTTACAATGTGAACGACACATTCCACAAGCGTCATGAAGAGGGGCACATG
CTGAACTGTACATGCTTCGGTCAGGGTCGGGGCAGGTGGAAGTGTGATCCCGTCGACCAATGCCAGGATTCAGAGAC
TGGGACGTTTTATCAAATTGGAGATTCATGGGAGAAGTATGTGCATGGTGTCAGATACCAGTGCTACTGCTATGGCC
GTGGCATTGGGGAGTGGCATTGCCAACCTTTACAGACCTATCCAAGCTCAAGTGGTCCTGTCGAAGTATTTATCACT
GAGACTCCGAGTCAGCCCAACTCCCACCCCATCCAGTGGAATGCACCACAGCCATCTCACATTTCCAAGTACATTCT
CAGGTGGAGACCTAAAAATTCTGTAGGCCGTTGGAAGGAAGCTACCATACCAGGCCACTTAAACTCCTACACCATCA
AAGGCCTGAAGCCTGGTGTGGTATACGAGGGCCAGCTCATCAGCATCCAGCAGTACGGCCACCAAGAAGTGACTCGC
TTTGACTTCACCACCACCAGCACCAGCACACCTGTGACCAGCAACACCGTGACAGGAGAGACGACTCCCTTTTCTCC
TCTTGTGGCCACTTCTGAATCTGTGACCGAAATCACAGCCAGTAGCTTTGTGGTCTCCTGGGTCTCAGCTTCCGACA
CCGTGTCGGGATTCCGGGTGGAATATGAGCTGAGTGAGGAGGGAGATGAGCCACAGTACCTGGATCTTCCAAGCACA
GCCACTTCTGTGAACATCCCTGACCTGCTTCCTGGCCGAAAATACATTGTAAATGTCTATCAGATATCTGAGGATGG
GGAGCAGAGTTTGATCCTGTCTACTTCACAAACAACAGCGCCTGATGCCCCTCCTGACCCGACTGTGGACCAAGTTG
ATGACACCTCAATTGTTGTTCGCTGGAGCAGACCCCAGGCTCCCATCACAGGGTACAGAATAGTCTATTCGCCATCA
GTAGAAGGTAGCAGCACAGAACTCAACCTTCCTGAAACTGCAAACTCCGTCACCCTCAGTGACTTGCAACCTGGTGT
TCAGTATAACATCACTATCTATGCTGTGGAAGAAAATCAAGAAAGTACACCTGTTGTCATTCAACAAGAAACCACTG
GCACCCCACGCTCAGATACAGTGCCCTCTCCCAGGGACCTGCAGTTTGTGGAAGTGACAGACGTGAAGGTCACCATC
ATGTGGACACCGCCTGAGAGTGCAGTGACCGGCTACCGTGTGGATGTGATCCCCGTCAACCTGCCTGGCGAGCACGG
GCAGAGGCTGCCCATCAGCAGGAACACCTTTGCAGAAGTCACCGGGCTGTCCCCTGGGGTCACCTATTACTTCAAAG
TCTTTGCAGTGAGCCATGGGAGGGAGAGCAAGCCTCTGACTGCTCAACAGACAACCAAACTGGATGCTCCCACTAAC
CTCCAGTTTGTCAATGAAACTGATTCTACTGTCCTGGTGAGATGGACTCCACCTCGGGCCCAGATAACAGGATACCG
ACTGACCGTGGGCCTTACCCGAAGAGGCCAGCCCAGGCAGTACAATGTGGGTCCCTCTGTCTCCAAGTACCCCCTGA
GGAATCTGCAGCCTGCATCTGAGTACACCGTATCCCTCGTGGCCATAAAGGGCAACCAAGAGAGCCCCAAAGCCACT
GGAGTCTTTACCACACTGCAGCCTGGGAGCTCTATTCCACCTTACAACACCGAGGTGACTGAGACCACCATCGTGAT
CACATGGACGCCTGCTCCAAGAATTGGTTTTAAGCTGGGTGTACGACCAAGCCAGGGAGGAGAGGCACCACGAGAAG
TGACTTCAGACTCAGGAAGCATCGTTGTGTCCGGCTTGACTCCAGGAGTAGAATACGTCTACACCATCCAAGTCCTG
AGAGATGGACAGGAAAGAGATGCGCCAATTGTAAACAAAGTGGTGACACCATTGTCTCCACCAACAAACTTGCATCT
GGAGGCAAACCCTGACACTGGAGTGCTCACAGTCTCCTGGGAGAGGAGCACCACCCCAGACATTACTGGTTATAGAA
TTACCACAACCCCTACAAACGGCCAGCAGGGAAATTCTTTGGAAGAAGTGGTCCATGCTGATCAGAGCTCCTGCACT
TTTGATAACCTGAGTCCCGGCCTGGAGTACAATGTCAGTGTTTACACTGTCAAGGATGACAAGGAAAGTGTCCCTAT
CTCTGATACCATCATCCCAGCTGTTCCTCCTCCCACTGACCTGCGATTCACCAACATTGGTCCAGACACCATGCGTG
TCACCTGGGCTCCACCCCCATCCATTGATTTAACCAACTTCCTGGTGCGTTACTCACCTGTGAAAAATGAGGAAGAT
GTTGCAGAGTTGTCAATTTCTCCTTCAGACAATGCAGTGGTCTTAACAAATCTCCTGCCTGGTACAGAATATGTAGT
GAGTGTCTCCAGTGTCTACGAACAACATGAGAGCACACCTCTTAGAGGAAGACAGAAAACAGGTCTTGATTCCCCAA
CTGGCATTGACTTTTCTGATATTACTGCCAACTCTTTTACTGTGCACTGGATTGCTCCTCGAGCCACCATCACTGGC
TACAGGATCCGCCATCATCCCGAGCACTTCAGTGGGAGACCTCGAGAAGATCGGGTGCCCCACTCTCGGAATTCCAT
CACCCTCACCAACCTCACTCCAGGCACAGAGTATGTGGTCAGCATCGTTGCTCTTAATGGCAGAGAGGAAAGTCCCT
TATTGATTGGCCAACAATCAACAGTTTCTGATGTTCCGAGGGACCTGGAAGTTGTTGCTGCGACCCCCACCAGCCTA
CTGATCAGCTGGGATGCTCCTGCTGTCACAGTGAGATATTACAGGATCACTTACGGAGAAACAGGAGGAAATAGCCC
TGTCCAGGAGTTCACTGTGCCTGGGAGCAAGTCTACAGCTACCATCAGCGGCCTTAAACCTGGAGTTGATTATACCA
TCACTGTGTATGCTGTCACTGGCCGTGGAGACAGCCCCGCAAGCAGCAAGCCAATTTCCATTAATTACCGAACAGAA
ATTGACAAACCATCCCAGATGCAAGTGACCGATGTTCAGGACAACAGCATTAGTGTCAAGTGGCTGCCTTCAAGTTC
CCCTGTTACTGGTTACAGAGTAACCACCACTCCCAAAAATGGACCAGGACCAACAAAAACTAAAACTGCAGGTCCAG
ATCAAACAGAAATGACTATTGAAGGCTTGCAGCCCACAGTGGAGTATGTGGTTAGTGTCTATGCTCAGAATCCAAGC
GGAGAGAGTCAGCCTCTGGTTCAGACTGCAGTAACCAACATTGATCGCCCTAAAGGACTGGCATTCACTGATGTGGA

FIGURE 52B

TGTCGATTCCATCAAAATTGCTTGGGAAAGCCCACAGGGGCAAGTTTCCAGGTACAGGGTGACCTACTCGAGCCCTG
AGGATGGAATCCATGAGCTATTCCCTGCACCTGATGGTGAAGAAGACACTGCAGAGCTGCAAGGCCTCAGACCGGGT
TCTGAGTACACAGTCAGTGTGGTTGCCTTGCACGATGATATGGAGAGCCAGCCCCTGATTGGAACCCAGTCCACAGC
TATTCCTGCACCAACTGACCTGAAGTTCACTCAGGTCACACCCACAAGCCTGAGCGCCCAGTGGACACCACCCAATG
TTCAGCTCACTGGATATCGAGTGCGGGTGACCCCCAAGGAGAAGACCGGACCAATGAAAGAAATCAACCTTGCTCCT
GACAGCTCATCCGTGGTTGTATCAGGACTTATGGTGGCCACCAAATATGAAGTGAGTGTCTATGCTCTTAAGGACAC
TTTGACAAGCAGACCAGCTCAGGGTGTTGTCACCACTCTGGAGAATGTCAGCCCACCAAGAAGGGCTCGTGTGACAG
ATGCTACTGAGACCACCATCACCATTAGCTGGAGAACCAAGACTGAGACGATCACTGGCTTCCAAGTTGATGCCGTT
CCAGCCAATGGCCAGACTCCAATCCAGAGAACCATCAAGCCAGATGTCAGAAGCTACACCATCACAGGTTTACAACC
AGGCACTGACTACAAGATCTACCTGTACACCTTGAATGACAATGCTCGGAGCTCCCCTGTGGTCATCGACGCCTCCA
CTGCCATTGATGCACCATCCAACCTGCGTTTCCTGGCCACCACACCCAATTCCTTGCTGGTATCATGGCAGCCGCCA
CGTGCCAGGATTACCGGCTACATCATCAAGTATGAGAAGCCTGGGTCTCCTCCCAGAGAAGTGGTCCCTCGGCCCCG
CCCTGGTGTCACAGAGGCTACTATTACTGGCCTGGAACCGGGAACCGAATATACAATTTATGTCATTGCCCTGAAGA
ATAATCAGAAGAGCGAGCCCCTGATTGGAAGGAAAAAGACAGACGAGCTTCCCCAACTGGTAACCCTTCCACACCCC
AATCTTCATGGACCAGAGATCTTGGATGTTCCTTCCACAGTTCAAAAGACCCCTTTCGTCACCCACCCTGGGTATGA
CACTGGAAATGGTATTCAGCTTCCTGGCACTTCTGGTCAGCAACCCAGTGTTGGGCAACAAATGATCTTTGAGGAAC
ATGGTTTTAGGCGGACCACACCGCCCACAACGGCCACCCCCATAAGGCATAGGCCAAGACCATACCCGCCGAATGTA
GGACAAGAAGCTCTCTCTCAGACAACCATCTCATGGCCCCATTCCAGGACACTTCTGAGTACATCATTTCATGTCA
TCCTGTTGGCACTGATGAAGAACCCTTACAGTTCAGGGTTCCTGGAACTTCTACCAGTGCCACTCTGACAGGCCTCA
CCAGAGGTGCCACCTACAACATCATAGTGGAGGCACTGAAAGACCAGCAGAGGCATAAGGTTCGGGAAGAGGTTGTT
ACCGTGGGCAACTCTGTCAACGAAGGCTTGAACCAACCTACGGATGACTCGTGCTTTGACCCCTACACAGTTTCCCA
TTATGCCGTTGGAGATGAGTGGGAACGAATGTCTGAATCAGGCTTTAAACTGTTGTGCCAGTGCTTAGGCTTTGGAA
GTGGTCATTTCAGATGTGATTCATCTAGATGGTGCCATGACAATGGTGTGAACTACAAGATTGGAGAGAAGTGGGAC
CGTCAGGGAGAAAATGGCCAGATGATGAGCTGCACATGTCTTGGGAACGGAAAAGGAGAATTCAAGTGTGACCCTCA
TGAGGCAACGTGTTACGATGATGGGAAGACATACCACGTAGGAGAACAGTGGCAGAAGGAATATCTCGGTGCCATTT
GCTCCTGCACATGCTTTGGAGGCCAGCGGGGCTGGCGCTGTGACAACTGCCGCAGACCTGGGGGTGAACCCAGTCCC
GAAGGCACTACTGGCCAGTCCTACAACCAGTATTCTCAGAGATACCATCAGAGAACAAACACTAATGTTAATTGCCC
AATTGAGTGCTTCATGCCTTTAGATGTACAGGCTGACAGAGAAGATTCCCGAGAGTAAATCATCTTTCCAATCCAGA
GGAACAAGCATGTCTCTCTGCCAAGATCCATCTAAACTGGAGTGATGTTAGCAGACCCAGCTTAGAGTTCTTCTTTC
TTTCTTAAGCCCTTTGCTCTGGAGGAAGTTCTCCAGCTTCAGCTCAACTCACAGCTTCTCCAAGCATCACCCTGGGA
GTTTCCTGAGGGTTTTCTCATAAATGAGGGCTGCACATTGCCTGTTCTGCTTCGAAGTATTCAATACCGCTCAGTAT
TTTAAATGAAGTGATTCTAAGATTTGGTTTGGGATCAATAGGAAAGCATATGCAGCCAACCAAGATGCAAATGTTTT
GAAATGATATGACCAAAATTTTAAGTAGGAAAGTCACCCAAACACTTCTGCTTTCACTTAAGTGTCTGGCCCGCAAT
ACTGTAGGAACAAGCATGATCTTGTTACTGTGATATTTTAAATATCCACAGTACTCACTTTTTCCAAATGATCCTAG
TAATTGCCTAGAAATATCTTTCTCTTACCTGTTATTTATCAATTTTTCCCAGTATTTTTATACGGAAAAAATTGTAT
TGAAAACACTTAGTATGCAGTTGATAAGAGGAATTTGGTATAATTATGGTGGGTGATTATTTTTTATACTGTATGTG
CCAAAGCTTTACTACTGTGGAAAGACAACTGTTTTAATAAAAGATTTACATTCCACA

FIGURE 53A

ACGCCCGCGCCGGCTGTGCTGCACAGGGGGAGGAGAGGGAACCCCAGGCGCGAGCGGGAAGAGGGGACCTGCAGCCA
CAACTTCTCTGGTCCTCTGCATCCCTTCTGTCCCTCCACCCGTCCCCTTCCCCACCCTCTGGCCCCCACCTTCTTGG
AGGCGACAACCCCCGGGAGGCATTAGAAGGGATTTTTCCCGCAGTTGCGAAGGGAAGCAAACTTGGTGGCAACTTGC
CTCCCGGTGCGGGCGTCTCTCCCCCACCGTCTCAACATGCTTAGGGGTCCGGGGCCCGGGCTGCTGCTGCTGGCCGT
CCAGTGCCTGGGGACAGCGGTGCCCTCCACGGGAGCCTCGAAGAGCAAGAGGCAGGCTCAGCAAATGGTTCAGCCCC
AGTCCCCGGTGGCTGTCAGTCAAAGCAAGCCCGGTTGTTATGACAATGGAAAACACTATCAGATAAATCAACAGTGG
GAGCGGACCTACCTAGGCAATGCGTTGGTTTGTACTTGTTATGGAGGAAGCCGAGGTTTTAACTGCGAGAGTAAACC
TGAAGCTGAAGAGACTTGCTTTGACAAGTACACTGGGAACACTTACCGAGTGGGTGACACTTATGAGCGTCCTAAAG
ACTCCATGATCTGGGACTGTACCTGCATCGGGGCTGGGCGAGGGAGAATAAGCTGTACCATCGCAAACCGCTGCCAT
GAAGGGGGTCAGTCCTACAAGATTGGTGACACCTGGAGGAGACCACATGAGACTGGTGGTTACATGTTAGAGTGTGT
GTGTCTTGGTAATGGAAAAGGAGAATGGACCTGCAAGCCCATAGCTGAGAAGTGTTTTGATCATGCTGCTGGGACTT
CCTATGTGGTCGGAGAAACGTGGGAGAAGCCCTACCAAGGCTGGATGATGGTAGATTGTACTTGCCTGGGAGAAGGC
AGCGGACGCATCACTTGCACTTCTAGAAATAGATGCAACGATCAGGACACAAGGACATCCTATAGAATTGGAGACAC
CTGGAGCAAGAAGGATAATCGAGGAAACCTGCTCCAGTGCATCTGCACAGGCAACGGCCGAGGAGAGTGGAAGTGTG
AGAGGCACACCTCTGTGCAGACCACATCGAGCGGATCTGGCCCCTTCACCGATGTTCGTGCAGCTGTTTACCAACCG
CAGCCTCACCCCCAGCCTCCTCCCTATGGCCACTGTGTCACAGACAGTGGTGTGGTCTACTCTGTGGGGATGCAGTG
GCTGAAGACACAAGGAAATAAGCAAATGCTTTGCACGTGCCTGGGCAACGGAGTCAGCTGCCAAGAGACAGCTGTAA
CCCAGACTTACGGTGGCAACTCAAATGGAGAGCCATGTGTCTTACCATTCACCTACAATGGCAGGACGTTCTACTCC
TGCACCACGGAAGGGCGACAGGACGGACATCTTTGGTGCAGCACAACTTCGAATTATGAGCAGGACCAGAAATACTC
TTTCTGCACAGACCACACTGTTTTGGTTCAGACTCGAGGAGGAAATTCCAATGGTGCCTTGTGCCACTTCCCCTTCC
TATACAACAACCACAATTACACTGATTGCACTTCTGAGGGCAGAAGAGACAACATGAAGTGGTGTGGGACCACACAG
AACTATGATGCCGACCAGAAGTTTGGGTTCTGCCCCATGGCTGCCCACGAGGAAATCTGCACAACCAATGAAGGGGT
CATGTACCGCATTGGAGATCAGTGGGATAAGCAGCATGACATGGGTCACATGATGAGGTGCACGTGTGTTGGGAATG
GTCGTGGGGAATGGACATGCATTGCCTACTCGCAGCTTCGAGATCAGTGCATTGTTGATGACATCACTTACAATGTG
AACGACACATTCCACAAGCGTCATGAAGAGGGGCACATGCTGAACTGTACATGCTTCGGTCAGGGTCGGGGCAGGTG
GAAGTGTGATCCCGTCGACCAATGCCAGGATTCAGAGACTGGGACGTTTTATCAAATTGGAGATTCATGGGAGAAGT
ATGTGCATGGTGTCAGATACCAGTGCTACTGCTATGGCCGTGGCATTGGGGAGTGGCATTGCCAACCTTTACAGACC
TATCCAAGCTCAAGTGGTCCTGTCGAAGTATTTATCACTGAGACTCCGAGTCAGCCCAACTCCCACCCCATCCAGTG
GAATGCACCACAGCCATCTCACATTTCCAAGTACATTCTCAGGTGGAGACCTAAAAATTCTGTAGGCCGTTGGAAGG
AAGCTACCATACCAGGCCACTTAAACTCCTACACCATCAAAGGCCTGAAGCCTGGTGTGGTATACGAGGGCCAGCTC
ATCAGCATCCAGCAGTACGGCCACCAAGAAGTGACTCGCTTTGACTTCACCACCACCAGCACCAGCACACCTGTGAC
CAGCAACACCGTGACAGGAGAGACGACTCCCTTTTCTCCTCTTGTGGCCACTTCTGAATCTGTGACCGAAATCACAG
CCAGTAGCTTTGTGGTCTCCTGGGTCTCAGCTTCCGACACCGTGTCGGGATTCCGGGTGGAATATGAGCTGAGTGAG
GAGGGAGATGAGCCACAGTACCTGGATCTTCCAAGCACAGCCACTTCTGTGAACATCCCTGACCTGCTTCCTGGCCG
AAAATACATTGTAAATGTCTATCAGATATCTGAGGATGGGGAGCAGAGTTTGATCCTGTCTACTTCACAAACAACAG
CGCCTGATGCCCCTCCTGACCCGACTGTGGACCAAGTTGATGACACCTCAATTGTTGTTCGCTGGAGCAGACCCCAG
GCTCCCATCACAGGGTACAGAATAGTCTATTCGCCATCAGTAGAAGGTAGCAGCACAGAACTCAACCTTCCTGAAAC
TGCAAACTCCGTCACCCTCAGTGACTTGCAACCTGGTGTTCAGTATAACATCACTATCTATGCTGTGGAAGAAAATC
AAGAAAGTACACCTGTTGTCATTCAACAAGAAACCACTGGCACCCCACGCTCAGATACAGTGCCCTCTCCCAGGGAC
CTGCAGTTTGTGGAAGTGACAGACGTGAAGGTCACCATCATGTGGACACCGCCTGAGAGTGCAGTGACCGGCTACCG
TGTGGATGTGATCCCCGTCAACCTGCCTGGCGAGCACGGGCAGAGGCTGCCCATCAGCAGGAACACCTTTGCAGAAG
TCACCGGGCTGTCCCCTGGGGTCACCTATTACTTCAAAGTCTTTGCAGTGAGCCATGGGAGGGAGAGCAAGCCTCTG
ACTGCTCAACAGACAACCAAACTGGATGCTCCCACTAACCTCCAGTTTGTCAATGAAACTGATTCTACTGTCCTGGT
GAGATGGACTCCACCTCGGGCCCAGATAACAGGATACCGACTGACCGTGGGCCTTACCCGAAGAGGCCAGCCCAGGC
AGTACAATGTGGGTCCCTCTGTCTCCAAGTACCCCCTGAGGAATCTGCAGCCTGCATCTGAGTACACCGTATCCCTC
GTGGCCATAAAGGGCAACCAAGAGAGCCCCAAAGCCACTGGAGTCTTTACCACACTGCAGCCTGGGAGCTCTATTCC
ACCTTACAACACCGAGGTGACTGAGACCACCATCGTGATCACATGGACGCCTGCTCCAAGAATTGGTTTTAAGCTGG
GTGTACGACCAAGCCAGGGAGGAGAGGCACCACGAGAAGTGACTTCAGACTCAGGAAGCATCGTTGTGTCCGGCTTG
ACTCCAGGAGTAGAATACGTCTACACCATCCAAGTCCTGAGAGATGGACAGGAAAGAGATGCGCCAATTGTAAACAA
AGTGGTGACACCATTGTCTCCACCAACAAACTTGCATCTGGAGGCAAACCCTGACACTGGAGTGCTCACAGTCTCCT
GGGAGAGGAGCACCACCCCAGACATTACTGGTTATAGAATTACCACAACCCCTACAAACGGCCAGCAGGGAAATTCT
TTGGAAGAAGTGGTCCATGCTGATCAGAGCTCCTGCACTTTTGATAACCTGAGTCCCGGCCTGGAGTACAATGTCAG
TGTTTACACTGTCAAGGATGACAAGGAAAGTGTCCCTATCTCTGATACCATCATCCCAGCTGTTCCTCCTCCCACTG
ACCTGCGATTCACCAACATTGGTCCAGACACCATGCGTGTCACCTGGGCTCCACCCCCATCCATTGATTTAACCAAC
TTCCTGGTGCGTTACTCACCTGTGAAAAATGAGGAAGATGTTGCAGAGTTGTCAATTTCTCCTTCAGACAATGCAGT
GGTCTTAACAAATCTCCTGCCTGGTACAGAATATGTAGTGAGTGTCTCCAGTGTCTACGAACAACATGAGAGCACAC
CTCTTAGAGGAAGACAGAAAACAGGTCTTGATTCCCCAACTGGCATTGACTTTTCTGATATTACTGCCAACTCTTTT
ACTGTGCACTGGATTGCTCCTCGAGCCACCATCACTGGCTACAGGATCCGCCATCATCCCGAGCACTTCAGTGGGAG
ACCTCGAGAAGATCGGGTGCCCCACTCTCGGAATTCCATCACCCTCACCAACCTCACTCCAGGCACAGAGTATGTGG
TCAGCATCGTTGCTCTTAATGGCAGAGAGGAAAGTCCCTTATTGATTGGCCAACAATCAACAGTTTCTGATGTTCCG
AGGGACCTGGAAGTTGTTGCTGCGACCCCCACCAGCCTACTGATCAGCTGGGATGCTCCTGCTGTCACAGTGAGATA
TTACAGGATCACTTACGGAGAAACAGGAGGAAATAGCCCTGTCCAGGAGTTCACTGTGCCTGGGAGCAAGTCTACAG

FIGURE 53B

CTACCATCAGCGGCCTTAAACCTGGAGTTGATTATACCATCACTGTGTATGCTGTCACTGGCCGTGGAGACAGCCCC
GCAAGCAGCAAGCCAATTTCCATTAATTACCGAACAGAAATTGACAAACCATCCCAGATGCAAGTGACCGATGTTCA
GGACAACAGCATTAGTGTCAAGTGGCTGCCTTCAAGTTCCCCTGTTACTGGTTACAGAGTAACCACCACTCCCAAAA
ATGGACCAGGACCAACAAAAACTAAAACTGCAGGTCCAGATCAAACAGAAATGACTATTGAAGGCTTGCAGCCCACA
GTGGAGTATGTGGTTAGTGTCTATGCTCAGAATCCAAGCGGAGAGAGTCAGCCTCTGGTTCAGACTGCAGTAACCAA
CATTGATCGCCCTAAAGGACTGGCATTCACTGATGTGGATGTCGATTCCATCAAAATTGCTTGGGAAAGCCCACAGG
GGCAAGTTTCCAGGTACAGGGTGACCTACTCGAGCCCTGAGGATGGAATCCATGAGCTATTCCCTGCACCTGATGGT
GAAGAAGACACTGCAGAGCTGCAAGGCCTCAGACCGGGTTCTGAGTACACAGTCAGTGTGGTTGCCTTGCACGATGA
TATGGAGAGCCAGCCCCTGATTGGAACCCAGTCCACAGCTATTCCTGCACCAACTGACCTGAAGTTCACTCAGGTCA
CACCCACAAGCCTGAGCGCCCAGTGGACACCACCCAATGTTCAGCTCACTGGATATCGAGTGCGGGTGACCCCCAAG
GAGAAGACCGGACCAATGAAAGAAATCAACCTTGCTCCTGACAGCTCATCCGTGGTTGTATCAGGACTTATGGTGGC
CACCAAATATGAAGTGAGTGTCTATGCTCTTAAGGACACTTTGACAAGCAGACCAGCTCAGGGTGTTGTCACCACTC
TGGAGAATGTCAGCCCACCAAGAAGGGCTCGTGTGACAGATGCTACTGAGACCACCATCACCATTAGCTGGAGAACC
AAGACTGAGACGATCACTGGCTTCCAAGTTGATGCCGTTCCAGCCAATGGCCAGACTCCAATCCAGAGAACCATCAA
GCCAGATGTCAGAAGCTACACCATCACAGGTTTACAACCAGGCACTGACTACAAGATCTACCTGTACACCTTGAATG
ACAATGCTCGGAGCTCCCCTGTGGTCATCGACGCCTCCACTGCCATTGATGCACCATCCAACCTGCGTTTCCTGGCC
ACCACACCCAATTCCTTGCTGGTATCATGGCAGCCGCCACGTGCCAGGATTACCGGCTACATCATCAAGTATGAGAA
GCCTGGGTCTCCTCCCAGAGAAGTGGTCCCTCGGCCCCGCCCTGGTGTCACAGAGGCTACTATTACTGGCCTGGAAC
CGGGAACCGAATATACAATTTATGTCATTGCCCTGAAGAATAATCAGAAGAGCGAGCCCCTGATTGGAAGGAAAAAG
ACAGACGAGCTTCCCCAACTGGTAACCCTTCCACACCCCAATCTTCATGGACCAGAGATCTTGGATGTTCCTTCCAC
AGTTCAAAAGACCCCTTTCGTCACCCACCCTGGGTATGACACTGGAAATGGTATTCAGCTTCCTGGCACTTCTGGTC
AGCAACCCAGTGTTGGGCAACAAATGATCTTTGAGGAACATGGTTTTAGGCGGACCACACCGCCCACAACGGCCACC
CCCATAAGGCATAGGCCAAGACCATACCCGCCGAATGTAGGACAAGAAGCTCTCTCTCAGACAACCATCTCATGGGC
CCCATTCCAGGACACTTCTGAGTACATCATTTCATGTCATCCTGTTGGCACTGATGAAGAACCCTTACAGTTCAGGG
TTCCTGGAACTTCTACCAGTGCCACTCTGACAGGCCTCACCAGAGGTGCCACCTACAACATCATAGTGGAGGCACTG
AAAGACCAGCAGAGGCATAAGGTTCGGGAAGAGGTTGTTACCGTGGGCAACTCTGTCAACGAAGGCTTGAACCAACC
TACGGATGACTCGTGCTTTGACCCCTACACAGTTTCCCATTATGCCGTTGGAGATGAGTGGGAACGAATGTCTGAAT
CAGGCTTTAAACTGTTGTGCCAGTGCTTAGGCTTTGGAAGTGGTCATTTCAGATGTGATTCATCTAGATGGTGCCAT
GACAATGGTGTGAACTACAAGATTGGAGAGAAGTGGGACCGTCAGGGAGAAAATGGCCAGATGATGAGCTGCACATG
TCTTGGGAACGGAAAAGGAGAATTCAAGTGTGACCCTCATGAGGCAACGTGTTACGATGATGGGAAGACATACCACG
TAGGAGAACAGTGGCAGAAGGAATATCTCGGTGCCATTTGCTCCTGCACATGCTTTGGAGGCCAGCGGGGCTGGCGC
TGTGACAACTGCCGCAGACCTGGGGGTGAACCCAGTCCCGAAGGCACTACTGGCCAGTCCTACAACCAGTATTCTCA
GAGATACCATCAGAGAACAAACACTAATGTTAATTGCCCAATTGAGTGCTTCATGCCTTTAGATGTACAGGCTGACA
GAGAAGATTCCCGAGAG<u>TAA</u>ATCATCTTTCCAATCCAGAGGAACAAGCATGTCTCTCTGCCAAGATCCATCTAAACT
GGAGTGATGTTAGCAGACCCAGCTTAGAGTTCTTCTTTCTTTCTTAAGCCCTTTGCTCTGGAGGAAGTTCTCCAGCT
TCAGCTCAACTCACAGCTTCTCCAAGCATCACCCTGGGAGTTTCCTGAGGGTTTTCTCATAAATGAGGGCTGCACAT
TGCCTGTTCTGCTTCGAAGTATTCAATACCGCTCAGTATTTTAAATGAAGTGATTCTAAGATTTGGTTTGGGATCAA
TAGGAAAGCATATGCAGCCAACCAAGATGCAAATGTTTTGAAATGATATGACCAAAATTTTAAGTAGGAAAGTCACC
CAAACACTTCTGCTTTCACTTAAGTGTCTGGCCCGCAATACTGTAGGAACAAGCATGATCTTGTTACTGTGATATTT
TAAATATCCACAGTACTCACTTTTTCCAAATGATCCTAGTAATTGCCTAGAAATATCTTTCTCTTACCTGTTATTTA
TCAATTTTTCCCAGTATTTTTATACGGAAAAAATTGTATTGAAAACACTTAGTATGCAGTTGATAAGAGGAATTTGG
TATAATTATGGTGGGTGATTATTTTTTATACTGTATGTGCCAAAGCTTTACTACTGTGGAAAGACAACTGTTTTAAT
AAAAGATTTACATTCCACA

FIGURE 54

CTAACCCAGAAACATCCAATTCTCAAACTGAAGCTCGCACTCTCGCCTCCAGCATGAAAGTCTCTGCCGCCCTTCTG
TGCCTGCTGCTCATAGCAGCCACCTTCATTCCCCAAGGGCTCGCTCAGCCAGATGCAATCAATGCCCCAGTCACCTG
CTGTTATAACTTCACCAATAGGAAGATCTCAGTGCAGAGGCTCGCGAGCTATAGAAGAATCACCAGCAGCAAGTGTC
CCAAAGAAGCTGTGATCTTCAAGACCATTGTGGCCAAGGAGATCTGTGCTGACCCCAAGCAGAAGTGGGTTCAGGAT
TCCATGGACCACCTGGACAAGCAAACCCAAACTCCGAAGACTTGAACACTCACTCCACAACCCAAGAATCTGCAGCT
AACTTATTTTCCCCTAGCTTTCCCCAGACACCCTGTTTTATTTTATTATAATGAATTTTGTTTGTTGATGTGAAACA
TTATGCCTTAAGTAATGTTAATTCTTATTTAAGTTATTGATGTTTTAAGTTTATCTTTCATGGTACTAGTGTTTTTT
AGATACAGAGACTTGGGGAAATTGCTTTTCCTCTTGAACCACAGTTCTACCCCTGGGATGTTTTGAGGGTCTTTGCA
AGAATCATTAATACAAAGAATTTTTTTTAACATTCCAATGCATTGCTAAAATATTATTGTGGAAATGAATATTTTGT
AACTATTACACCAAATAAATATATTTTTGTAC

FIGURE 55

CGGCCCAGTGATCTTGAACCCCAAAGGCCAGAACTGGAGCCTCAGTCCAGAGAATTCTGAGAAAATTAAAGCAGAGA
GGAGGGGAGAGATCACTGGGACCAGGCCGTGATCTCTATGCCCGAGTCTCAACCCTCAACTGTCACCCCAAGGCACT
TGGGACGTCCTGGACAGACCGAGTCCCGGGAAGCCCCAGCACTGCCGCTGCCACACTGCCCTGAGCCCAAATGGGGG
AGTGAGAGGCCATAGCTGTCTGGCATGGGCCTCTCCACCGTGCCTGACCTGCTGCTGCCGCTGGTGCTCCTGGAGCT
GTTGGTGGGAATATACCCCTCAGGGGTTATTGGACTGGTCCCTCACCTAGGGGACAGGGAGAAGAGAGATAGTGTGT
GTCCCCAAGGAAAATATATCCACCCTCAAAATAATTCGATTTGCTGTACCAAGTGCCACAAAGGAACCTACTTGTAC
AATGACTGTCCAGGCCCGGGGCAGGATACGGACTGCAGGGAGTGTGAGAGCGGCTCCTTCACCGCTTCAGAAAACCA
CCTCAGACACTGCCTCAGCTGCTCCAAATGCCGAAAGGAAATGGGTCAGGTGGAGATCTCTTCTTGCACAGTGGACC
GGGACACCGTGTGTGGCTGCAGGAAGAACCAGTACCGGCATTATTGGAGTGAAAACCTTTTCCAGTGCTTCAATTGC
AGCCTCTGCCTCAATGGGACCGTGCACCTCTCCTGCCAGGAGAAACAGAACACCGTGTGCACCTGCCATGCAGGTTT
CTTTCTAAGAGAAAACGAGTGTGTCTCCTGTAGTAACTGTAAGAAAAGCCTGGAGTGCACGAAGTTGTGCCTACCCC
AGATTGAGAATGTTAAGGGCACTGAGGACTCAGGCACCACAGTGCTGTTGCCCCTGGTCATTTTCTTTGGTCTTTGC
CTTTTATCCCTCCTCTTCATTGGTTTAATGTATCGCTACCAACGGTGGAAGTCCAAGCTCTACTCCATTGTTTGTGG
GAAATCGACACCTGAAAAAGAGGGGGAGCTTGAAGGAACTACTACTAAGCCCCTGGCCCCAAACCCAAGCTTCAGTC
CCACTCCAGGCTTCACCCCCACCCTGGGCTTCAGTCCCGTGCCCAGTTCCACCTTCACCTCCAGCTCCACCTATACC
CCCGGTGACTGTCCCAACTTTGCGGCTCCCCGCAGAGAGGTGGCACCACCCTATCAGGGGGCTGACCCCATCCTTGC
GACAGCCCTCGCCTCCGACCCCATCCCCAACCCCCTTCAGAAGTGGGAGGACAGCGCCCACAAGCCACAGAGCCTAG
ACACTGATGACCCCGCGACGCTGTACGCCGTGGTGGAGAACGTGCCCCCGTTGCGCTGGAAGGAATTCGTGCGGCGC
CTAGGGCTGAGCGACCACGAGATCGATCGGCTGGAGCTGCAGAACGGGCGCTGCCTGCGCGAGGCGCAATACAGCAT
GCTGGCGACCTGGAGGCGGCGCACGCCGCGGCGCGAGGCCACGCTGGAGCTGCTGGGACGCGTGCTCCGCGACATGG
ACCTGCTGGGCTGCCTGGAGGACATCGAGGAGGCGCTTTGCGGCCCCGCCGCCCTCCCGCCCGCGCCCAGTCTTCTC
AGATGAGGCTGCGCCCCTGCGGGCAGCTCTAAGGACCGTCCTGCGAGATCGCCTTCCAACCCCACTTTTTCTGGAA
AGGAGGGGTCCTGCAGGGGCAAGCAGGAGCTAGCAGCCGCCTACTTGGTGCTAACCCCTCGATGTACATAGCTTTTC
TCAGCTGCCTGCGCGCCGCCGACAGTCAGCGCTGTGCGCGGAGAGAGGTGCGCCGTGGGCTCAAGAGCCTGAGTG
GGTGGTTTGCGAGGATGAGGGACGCTATGCCTCATGCCCGTTTTGGGTGTCCTCACCAGCAAGGCTGCTCGGGGGCC
CCTGGTTCGTCCCTGAGCCTTTTTCACAGTGCATAAGCAGTTTTTTTTGTTTTTGTTTTGTTTTGTTTTGTTTTTAA
ATCAATCATGTTACACTAATAGAAACTTGGCACTCCTGTGCCCTCTGCCTGGACAAGCACATAGCAAGCTGAACTGT
CCTAAGGCAGGGGCGAGCACGGAACAATGGGGCCTTCAGCTGGAGCTGTGGACTTTTGTACATACACTAAAATTCTG
AAGTT

FIGURE 56

CCCACGCGTCCGCTGGGGAGAGAGGAACAAAGGACCGTGAAAGCTGCTCTGTAAAAGCTGACACAGCCCTCCCAAGT
GAGCAGGACTGTTCTTCCCACTGCAATCTGACAGTTTACTGCATGCCTGGAGAGAACACAGCAGTAAAAACCAGGTT
TGCTACTGGAAAAAGAGGAAAGAGAAGACTTTCATTGACGGACCCAGCCATGGCAGCGTAGCAGCCCTGCGTTTCAG
ACGGCAGCAGCTCGGGACTCTGGACGTGTGTTTGCCCTCAAGTTTGCTAAGCTGCTGGTTTATTACTGAAGAAAGAA
TGTGGCAGATTGTTTTCTTTACTCTGAGCTGTGATCTTGTCTTGGCCGCAGCCTATAACAACTTTCGGAAGAGCATG
GACAGCATAGGAAAGAAGCAATATCAGGTCCAGCATGGGTCCTGCAGCTACACTTTCCTCCTGCCAGAGATGGACAA
CTGCCGCTCTTCCTCCAGCCCCTACGTGTCCAATGCTGTGCAGAGGGACGCGCCGCTCGAATACGATGACTCGGTGC
AGAGGCTGCAAGTGCTGGAGAACATCATGGAAAACAACACTCAGTGGCTAATGAAGCTTGAGAATTATATCCAGGAC
AACATGAAGAAAGAAATGGTAGAGATACAGCAGAATGCAGTACAGAACCAGACGGCTGTGATGATAGAAATAGGGAC
AAACCTGTTGAACCAAACAGCGGAGCAAACGCGGAAGTTAACTGATGTGGAAGCCCAAGTATTAAATCAGACCACGA
GACTTGAACTTCAGCTCTTGGAACACTCCCTCTCGACAAACAAATTGGAAAAACAGATTTTGGACCAGACCAGTGAA
ATAAACAAATTGCAAGATAAGAACAGTTTCCTAGAAAAGAAGGTGCTAGCTATGGAAGACAAGCACATCATCCAACT
ACAGTCAATAAAAGAAGAGAAAGATCAGCTACAGGTGTTAGTATCCAAGCAAAATTCCATCATTGAAGAACTAGAAA
AAAAAATAGTGACTGCCACGGTGAATAATTCAGTTCTTCAGAAGCAGCAACATGATCTCATGGAGACAGTTAATAAC
TTACTGACTATGATGTCCACATCAAACTCAGCTAAGGACCCCACTGTTGCTAAAGAAGAACAAATCAGCTTCAGAGA
CTGTGCTGAAGTATTCAAATCAGGACACACCACGAATGGCATCTACACGTTAACATTCCCTAATTCTACAGAAGAGA
TCAAGGCCTACTGTGACATGGAAGCTGGAGGAGGCGGGTGGACAATTATTCAGCGACGTGAGGATGGCAGCGTTGAT
TTTCAGAGGACTTGGAAAGAATATAAAGTGGGATTTGGTAACCCTTCAGGAGAATATTGGCTGGGAAATGAGTTTGT
TTCGCAACTGACTAATCAGCAACGCTATGTGCTTAAAATACACCTTAAAGACTGGGAAGGGAATGAGGCTTACTCAT
TGTATGAACATTTCTATCTCTCAAGTGAAGAACTCAATTATAGGATTCACCTTAAAGGACTTACAGGGACAGCCGGC
AAAATAAGCAGCATCAGCCAACCAGGAAATGATTTTAGCACAAAGGATGGAGACAACGACAAATGTATTTGCAAATG
TTCACAAATGCTAACAGGAGGCTGGTGGTTTGATGCATGTGGTCCTTCCAACTTGAACGGAATGTACTATCCACAGA
GGCAGAACACAAATAAGTTCAACGGCATTAAATGGTACTACTGGAAAGGCTCAGGCTATTCGCTCAAGGCCACAACC
ATGATGATCCGACCAGCAGATTTCTAAACATCCCAGTCCACCTGAGGAACTGTCTCGAACTATTTTCAAAGACTTAA
GCCCAGTGCACTGAAAGTCACGGCTGCGCACTGTGTCCTCTTCCACCACAGAGGGCGTGTGCTCGGTGCTGACGGGA
CCCACATGCTCCAGATTAGAGCCTGTAAACTTTATCACCTAAACTTGCATCACTTAACGGACCAAAGCAAGACCCTA
AACATCCATAATTGTGATTAGACAGAACACCTATGCAAAGATGAACCCGAGGCTGAGAATCAGACTGACAGTTTACA
GACGCTGCTGTCACAACCAAGAATGTTATGTGCAAGTTTATCAGTAAATAACTGGAAAACAGAACACTTATGTTATA
CAATACAGATCATCTTGGAACTGCATTCTTCTGAGCACTGTTTATACACTGTGTAAATACCCATATGTCCTGAATTC
ACCATCACTATCACAATTAAAAGGAAGAAAAAAACTCTCTAAGCCATAAAAAGACATATTCAGGGATATTCTGAGAA
GGGGTTACTAGAAGTTTAATATTTGGAAAAACAGTTAGTGCATTTTTACTCCATCTCTTAGGTGCTTTAAATTTTTA
TTTCAAAAACAGCGTATTTACATTTATGTTGACAGCTTAGTTATAAGTTAATGCTCAAATACGTATTTCAAATTTAT
ATGGTAGAAACTTCCAGAATCTCTGAAATTATCAACAGAAACGTGCCATTTTAGTTTATATGCAGACCGTACTATTT
TTTTCTGCCTGATTGTTAAATATGAAGGTATTTTTAGTAATTAAATATAACTTATTAGGAAAAAAAAAAAAAAAAA
AAAAAAAAAAAAAAAAAAAAAAA

FIGURE 57A

CTGCAGCCATGGGTGCCCTATGGAGCTGGTGGATACTCTGGGCTGGAGCAACCCTCCTGTGGGGATTGACCCAGGAG
GCTTCAGTGGACCTCAAGAACACTGGCAGAGAGGAATTCCTCACAGCCTTCCTGCAGAACTATCAGCTGGCCTACAG
CAAGGCCTACCCCCGCCTCCTTATCTCCAGTCTGTCAGAGAGCCCCGCTTCAGTCTCCATCCTCAGCCAGGCAGACA
ACACCTCAAAGAAGGTCACAGTGAGGCCCGGGGAGTCGGTCATGGTCAACATCAGTGCCAAGGCTGAGATGATAGGC
AGCAAGATCTTCCAGCATGCGGTGGTGATCCATTCTGACTATGCCATCTCTGTGCAGGCACTAAATGCCAAGCCTGA
CACAGCGGAGCTGACACTGCTGCGGCCCATCCAGGCCCTAGGCACCGAGTATTTTGTGCTCACACCCCCCGGCACCT
CAGCCAGGAATGTCAAGGAGTTTGCCGTGGTGGCCGGTGCCGCAGGTGCCTCGGTCAGTGTCACGCTGAAGGGGTCA
GTGACATTCAATGGCAAGTTCTATCCAGCAGGCGATGTCCTAAGAGTGACTCTACAGCCCTACAATGTGGCCCAGCT
ACAGAGCTCAGTGGATCTCTCGGGGTCAAAGGTCACAGCTAGTAGCCCCGTGGCTGTCCTCTCTGGCCACAGCTGTG
CGCAGAAACATACGACCTGCAACCATGTGGTTGAGCAGCTGCTACCCACGTCTGCCTGGGGCACCCACTATGTAGTA
CCCACGCTGGCCTCCCAATCTCGCTATGATTTGGCCTTCGTTGTGGCCAGCCAGGCCACAAAGCTGACCTACAACCA
TGGGGGTATCACTGGCTCCCGTGGGCTCCAGGCAGGTGATGTGGTAGAGTTTGAGGTCCGGCCATCCTGGCCACTCT
ACCTGTCTGCAAATGTGGGCATCCAGGTCCTGTTGTTTGGCACAGGTGCCATAAGGAATGAAGTGACTTATGACCCC
TACCTGGTCCTGATCCCAGATGTGGCGGCCTACTGCCCAGCCTATGTGGTCAAGAGTGTACCAGGCTGTGAGGGCGT
GGCCCTGGTAGTGGCACAGACGAAGGCTATCAGCGGGCTGACCATAGATGGGCATGCAGTGGGGGCCAAGCTCACCT
GGGAGGCTGTGCCAGGCAGTGAGTTCTCGTATGCTGAAGTGGAGCTCGGCACAGCTGACATGATCCACACGGCCGAG
GCCACCACCAACTTGGGACTGCTCACCTTCGGGCTGGCCAAGGCTATAGGCTACGCAACAGCTGCTGATTGCGGCCG
GACTGTACTGTCCCCAGTGGAGCCCTCCTGCGAAGGCATGCAGTGCGCAGCCGGGCAGCGCTGCCAGGTGGTAGGCG
GGAAGGCCGGGTGTGTGGCGGAGTCCACCGCTGTCTGCCGCGCCCAGGGCGACCCCCATTACACCACCTTCGACGGC
CGTCGCTACGACATGATGGGCACCTGTTCGTACACGATGGTGGAGCTGTGCAGCGAGGACGACACCCTGCCCGCCTT
CAGCGTGGAGGCCAAGAACGAGCACCGGGGCAGCCGCCGCGTCTCCTACGTGGGCCTCGTCACTGTGCGCGCCTACA
GCCACTCTGTGTCGCTGACCCGCGGTGAAGTTGGCTTCGTCCTGGTTGACAACCAGCGCTCGCGCCTGCCAGTCTCC
CTGAGTGAGGGTCGCCTGCGTGTGTACCAGAGCGGACCACGGGCCGTGGTGGAGCTGGTCTTTGGGCTGGTGGTCAC
TTATGACTGGGACTGCCAGCTGGCACTCAGCCTGCCTGCACGCTTCCAAGACCAGGTGTGCGGGCTGTGTGGCAACT
ATAATGGTGACCCAGCAGACGACTTCCTCACGCCTGACGGGGCTCTGGCTCCTGACGCTGTGGAGTTCGCAAGTAGC
TGGAAGCTGGATGATGGGGACTACCTGTGTGAGGATGGCTGCCAGAACAACTGTCCCGCCTGCACCCCAGGCCAGGC
CCAACACTATGAGGGCGACCGACTCTGTGGCATGCTGACCAAGCTCGATGGCCCCTTCGCTGTCTGCCATGACACCC
TGGACCCCAGGCCCTTCCTGGAGCAGTGTGTATATGACCTGTGTGTGGTCGGTGGGGAGCGGCTCAGCCTGTGCCGT
GGCCTCAGCGCCTATGCCCAGGCCTGTCTGGAGCTTGGCATCTCGGTTGGGGACTGGAGATCACCAGCCAACTGCCC
CCTGTCCTGCCCTGCCAACAGCCGCTATGAGCTCTGCGGCCCTGCTTGCCCGACCTCCTGCAACGGGGCTGCGGCGC
CGTCCAACTGCTCCGGGCGCCCCTGCGTGGAGGGCTGCGTGTGCCTCCCAGGCTTCGTGGCCAGCGGCGGCGCCTGC
GTGCCGGCCTCGTCGTGTGGCTGCACCTTCCAGGGTCTCCAGCTCGCTCCGGGCCAGGAAGTGTGGGCGGACGAGTT
GTGCCAAAGGCGCTGCACCTGCAACGGCGCCACCCATCAGGTCACCTGCCGCGACAAGCAGAGCTGCCCGGCGGGTG
AGCGCTGCAGCGTCCAGAACGGCCTCCTGGGCTGCTACCCCGATCGCTTCGGGACCTGCCAGGGGTCCGGGGACCCA
CACTATGTGAGCTTCGACGGCCGGCGCTTCGACTTCATGGGCACCTGCACGTACCTGCTGGTCGGCTCATGCGGCCA
GAACGCAGCGCTGCCTGCCTTCCGGGTGCTGGTGGAAAACGAGCATCGGGGCAGCCAGACTGTGAGCTACACGCGCG
CCGTGCGGGTGGAGGCCCGCGGGGTGAAGGTGGCCGTGCGCCGGGAGTACCCCGGGCAAGTGCTGGTGGATGACGTC
CTTCAGTATCTGCCCTTCCAAGCAGCAGATGGGCAGGTGCAGGTGTTCCGACAGGGCAGGGATGCCGTCGTGCGCAC
GGACTTTGGCCTGACTGTCACTTATGACTGGAATGCACGAGTGACTGCCAAGGTGCCCAGCAGCTATGCTGAGGCCC
TGTGTGGACTCTGTGGGAACTTCAACGGGGACCCAGCTGATGACCTGGCTCTGCGGGGTGGGGGTCAAGCTGCCAAT
GCACTGGCCTTTGGGAACAGCTGGCAAGAAGAGACGAGGCCCGGCTGTGGAGCAACTGAACCGGGTGACTGTCCCAA
GCTGGACTCCCTGGTGGCCCAGCAGCTGCAGAGCAAGAATGAGTGTGGAATCCTTGCCGACCCCAAGGGGCCCTTCC
GGGAGTGCCATAGCAAGCTGGACCCCCAGGGTGCCGTGCGCGACTGTGTCTATGACCGCTGCCTGCTGCCAGGCCAG
TCTGGGCCACTGTGTGACGCACTGGCCACCTATGCTGCTGCATGCCAGGCTGCTGGAGCCACAGTGCACCCCTGGAG
GAGTGAAGAACTTTGCCCACTGAGCTGCCCACCCCACAGCCACTATGAGGCGTGTTCCTACGGCTGCCCGCTGTCCT
GTGGAGACCTCCCAGTGCCCGGGGGCTGTGGCTCAGAATGCCATGAGGGCTGCGTGTGCGATGAGGGCTTTGCGCTC
AGTGGTGAGTCCTGCCTGCCCCTGGCCTCCTGTGGCTGCGTACACCAGGGCACCTACCACCCACCAGGCCAGACCTT
CTACCCTGGCCCCGGATGTGATTCCCTTTGCCACTGCCAGGAGGGCGGCCTGGTGTCCTGTGAGTCCTCCAGCTGCG
GACCGCACGAGGCCTGCCAGCCATCCGGTGGCAGCTTGGGCTGTGTGGCCGTGGGCTCTAGCACCTGCCAGGCGTCA
GGAGACCCCCACTACACCACCTTCGATGGCCGCCGCTTCGACTTCATGGGCACCTGCGTGTATGTGCTGGCTCAGAC
CTGCGGCACCCGGCCTGGCCTGCATCGGTTTGCCGTCCTGCAGGAGAACGTGGCCTGGGGTAATGGGCGAGTCAGTG
TGACCAGGGTGATCACGGTCCAGGTGGCAAACTTCACCCTGCGGCTGGAGCAGAGACAGTGGAAGGTCACGGTGAAC
GGTGTGGACATGAAGCTGCCCGTGGTGCTGGCCAACGGCCAGATCCGTGCCTCCCAGCATGGTTCAGATGTTGTGAT
TGAGACCGACTTCGGCCTGCGTGTGGCCTACGACCTTGTGTACTATGTGCGGGTCACCGTCCCCGGAAACTACTACC
AGCAGATGTGTGGCCTGTGTGGGAACTACAACGGCGACCCCAAGGATGACTTCCAGAAGCCCAATGGCTCACAGGCA
GGCAACGCCAATGAGTTCGGCAACTCCTGGGAGGAGGTGGTGCCCGACTCTCCCTGCCTGCCGCCCACCCCTTGCCC
GCCGGGGAGCGAGGACTGTATCCCCAGCCACAAGTGTCCTCCCGAGCTGGAGAAGAAGTATCAGAAGGAGGAGTTCT
GTGGGCTCCTCTCCAGCCCCACAGGGCCACTGTCCTCCTGCCACAAGCTGGTGGATCCCCAGGGTCCCTTGAAAGAT
TGCATCTTTGATCTCTGCCTGGGTGGTGGGAACCTGAGCATTCTCTGCAGCAACATCCATGCCTACGTGAGTGCTTG
CCAGGCGGCTGGAGGCCACGTGGAGCCCTGGAGGACTGAAACTTTCTGTCCCATGGAGTGCCCTCCGAACAGTCACT
ACGAGCTCTGTGCGGACACCTGCTCCCTGGGCTGCTCAGCTCTCAGTGCCCCTCCACAGTGCCAGGATGGGTGTGCT
GAGGGCTGCCAGTGTGACTCCGGCTTCCTCTACAATGGCCAAGCCTGCGTGCCCATCCAGCAATGCGGCTGCTACCA

FIGURE 57B

CAATGGTGTCTACTATGAGCCGGAGCAGACAGTCCTCATTGACAACTGTCGGCAGCAGTGCACGTGCCATGCGGGTA
AAGGCATGGTGTGCCAGGAACACAGCTGCAAGCCGGGGCAGGTGTGCCAGCCCTCCGGAGGCATCCTGAGCTGCGTC
ACCAAAGACCCGTGCCACGGCGTGACATGCCGGCCACAGGAGACATGCAAGGAGCAGGGTGGCCAGGGCGTGTGCCT
GCCCAACTATGAGGCCACGTGCTGGCTGTGGGGCGACCCACACTACCACTCCTTCGATGGCCGGAAGTTTGACTTCC
AGGGCACCTGTAACTATGTGCTGGCAACAACTGGCTGCCCGGGGGTCAGCACCCAGGGCCTGACACCCTTCACCGTC
ACCACCAAGAACCAGAACCGGGGCAACCCTGCTGTGTCCTACGTGAGAGTCGTCACCGTGGCTGCCCTCGGCACCAA
CATCTCCATCCACAAGGACGAGATCGGCAAAGTCCGGGTGAACGGTGTGCTCACAGCCTTGCCTGTCTCTGTGGCCG
ACGGGCGGATTTCAGTGACCCAGGGTGCATCGAAGGCACTGCTGGTGGCTGACTTTGGACTGCAAGTCAGCTATGAC
TGGAACTGGCGGGTAGACGTGACGCTGCCCAGCAGCTATCATGGCGCAGTGTGCGGGCTCTGCGGTAACATGGACCG
CAACCCCAACAATGACCAGGTCTTCCCTAATGGCACACTGGCTCCCTCCATACCCATCTGGGGCGGCAGCTGGCGAG
CCCCAGGCTGGGACCCACTGTGTTGGGACGAATGTCGGGGGTCCTGCCCAACGTGCCCTGAGGACCGGTTGGAGCAG
TACGAGGGCCCTGGCTTCTGCGGACCCCTGGCCCCCGGCACAGGGGGCCCTTTCACCACCTGCCATGCTCATGTGCC
ACCTGAGAGCTTCTTCAAGGGCTGTGTTCTGGACGTCTGCATGGGTGGTGGGGACCGTGACATTCTTTGCAAGGCTC
TGGCTTCCTATGTGGCCGCCTGCCAGGCTGCTGGGGTTGTCATCGAAGACTGGCGGGCACAGGTTGGCTGTGAGATC
ACCTGCCCAGAAAACAGCCACTATGAGGTCTGTGGCCCACCCTGCCCGGCCAGCTGTCCGTCCCCTGCACCCCTTAC
GACGCCAGCCGTATGTGAGGGCCCCTGTGTGGAGGGCTGCCAGTGCGACGCGGGTTTCGTGTTAAGTGCTGACCGCT
GTGTTCCCCTCAACAACGGCTGCGGCTGCTGGGCCAATGGCACCTACCACGAGGCGGGCAGTGAGTTTTGGGCTGAT
GGCACCTGCTCCCAGTGGTGTCGCTGCGGGCCTGGGGGTGGCTCGCTGGTCTGCACACCTGCCAGCTGTGGGCTGGG
TGAAGTGTGTGGCCTCCTGCCATCCGGCCAGCACGGCTGCCAGCCCGTCAGCACAGCTGAGTGCCAGGCGTGGGGTG
ACCCCCATTACGTCACTCTGGATGGGCACCGATTCAATTTCCAAGGCACCTGCGAGTACCTGCTGAGTGCACCCTGC
CACGGACCACCCTTGGGGGCTGAGAACTTCACTGTCACTGTAGCCAATGAGCACCGGGGCAGCCAGGCTGTCAGCTA
CACCCGCAGTGTCACCCTGCAAATCTACAACCACAGCCTGACACTGAGTGCCCGCTGGCCCCGGAAGCTACAGGTGG
ACGGCGTGTTCGTCACTCTGCCCTTCCAGCTGGACTCGCTCCTGCACGCACACCTGAGCGGCGCCGACGTGGTGGTG
ACCACAACCTCAGGGCTCTCGCTGGCTTTCGACGGGGACAGCTTCGTGCGCCTGCGCGTGCCGGCGGCGTACGCGGG
CTCTCTCTGTGGCTTATGCGGGAACTACAACCAGGACCCCGCAGACGACCTGAAGGCGGTGGGCGGGAAGCCCGCCG
GATGGCAGGTGGGCGGCGCCCAGGGCTGCGGGGAATGTGTGTCCAAGCCATGCCCGTCGCCGTGCACCCCAGAGCAG
CAAGAGTCCTTCGGCGGCCCGGACGCCTGCGGCGTGATCTCCGCCACCGACGGCCCGCTGGCGCCCTGCCACGGCCT
TGTGCCGCCCGCGCAGTACTTCCAGGGCTGCTTGCTGGACGCCTGCCAAGTTCAGGGCCATCCTGGAGGCCTCTGTC
CTGCAGTGGCCACCTACGTGGCAGCCTGTCAGGCCGCTGGGGCCCAGCTCCGCGAGTGGAGGCGGCCGGACTTCTGT
CCCTTCCAGTGCCCTGCCCACAGCCACTACGAGCTCTGCGGTGACTCCTGTCCTGGGAGCTGCCCGAGCCTGTCGGC
ACCCGAGGGCTGTGAGTCGGCCTGCCGTGAAGGCTGTGTCTGCGATGCTGGCTTCGTGCTCAGTGGTGACACGTGTG
TACCTGTGGGCCAGTGTGGCTGCCTCCACGATGACCGCTACTACCCACTGGGCCAGACCTTCTACCCTGGCCCTGGG
TGTGATTCCCTTTGCCGCTGCCGGGAGGGCGGTGAGGTGTCCTGTGAGCCCTCCAGCTGCGGCCCGCATGAGACCTG
CCGGCCATCCGGTGGCAGCTTGGGCTGCGTGGCCGTGGGCTCTACCACCTGCCAGGCGTCGGGAGATCCCCACTACA
CCACCTTCGATGGCCGCCGCTTCGACTTCATGGGCACCTGCGTGTATGTGCTGGCTCAGACCTGCGGCACCCGGCCT
GGCCTACATCGGTTTGCCGTCCTGCAGGAGAACGTGGCCTGGGGTAATGGGCGAGTCAGTGTGACCAGGGTGATCAC
GGTCCAGGTGGCAAACTTCACCCTGCGGCTGGAGCAGAGACAGTGGAAGGTCACGGTGAACGGTGTGGACATGAAGC
TGCCCGTGGTGCTGGCCAACGGCCAGATCCGTGCCTCCCAGCATGGTTCAGATGTTGTGATTGAGACCGACTTCGGC
CTGCGTGTGGCCTACGACCTTGTGTACTATGTGCGGGTCACCGTCCCTGGAAACTACTACCAGCTGATGTGTGGCCT
GTGTGGGAACTACAACGGCGACCCCAAGGATGACTTCCAGAAGCCCAATGGCTCGCAGGCAGGCAACGCCAATGAGT
TCGGCAACTCCTGGGAGGAGGTGGTGCCCGACTCTCCCTGCCTGCCGCCGCCCACCTGCCCGCCGGGGAGCGAGGGC
TGTATCCCCAGCGAGGAGTGTCCTCCCGAGCTGGAGAAGAAGTATCAGAAGGAGGAGTTCTGTGGGCTCCTCTCCAG
CCCCACAGGGCCACTGTCCTCCTGCCACAAGCTGGTGGATCCCCAGGGTCCCTTGAAAGATTGCATCTTTGATCTCT
GCCTGGGTGGTGGGAACCTGAGCATTCTCTGCAGCAACATCCATGCCTACGTGAGTGCTTGCCAGGCGGCTGGAGGC
CACGTGGAGCCCTGGAGGAATGAAACTTTCTGTCCCATGGAATGCCCTCAGAACAGTCACTACGAGCTCTGTGCGGA
CACCTGCTCCCTGGGCTGCTCGGCTCTCAGTGCCCCTCTGCAGTGCCCAGATGGGTGTGCTGAGGGCTGCCAGTGTG
ACTCCGGCTTCCTCTACAACGGCCAAGCCTGCGTGCCCATCCAGCAATGTGGCTGCTACCACAATGGTGCCTACTAT
GAGCCGGAGCAGACAGTCCTCATTGACAACTGTCGGCAGCAGTGCACGTGCCATGCGGGTAAAGTCGTGGTGTGCCA
GGAACACAGCTGCAAGCCGGGGCAGGTGTGCCAGCCCTCCGGAGGCATCCTGAGCTGCGTCACCAAAGACCCGTGCC
ACGGCGTGACATGCCGGCCACAGGAGACATGCAAGGAGCAGGGTGGCCAGGGTGTGTGCCTGCCCAACTATGAGGCC
ACGTGCTGGCTGTGGGGCGACCCACACTACCACTCCTTCGATGGCCGGAAGTTTGACTTCCAGGGCACCTGTAACTA
TGTGCTGGCAACAACTGGCTGCCCGGGGGTCAGCACCCAGGGCCTGACACCCTTCACCGTCACCACCAAGAACCAGA
ACCGGGGCAACCCTGCTGTATCCTACGTGAGAGTCGTCACCGTGGCTGCCCTCGGCACCAACATCTCCATCCACAAG
GACGAGATCGGCAAAGTCCGGGTGAACGGTGTGCTCACAGCCTTGCCTGTCTCCGTGGCCGACGGGCGGATTTCAGT
GGCCCAGGGTGCATCGAAGGCACTGCTGGTGGCTGACTTTGGACTGCAAGTCAGCTATGACTGGAACTGGCGGGTAG
ACGTGACGCTCCCCAGCAGCTATCATGGCGCAGTGTGCGGGCTCTGCGGTAACATGGACCGCAACCCCAACAATGAC
CAGGTCTTCCCTAATGGCACACTGGCTCCCTCCATACCCATCTGGGGCGGCAGCTGGCGAGCCCCAGGCTGGGACCC
ACTGTGTTGGGACGAATGTCGGGGGTCCTGCCCAACGTGCCCTGAGGACCGGTTGGAGCAGTACGAGGGCCCTGGCT
TCTGCGGACCCCTGGCCCCCGGCACAGGGGGCCCTTTCACCACCTGCCATGCTCATGTGCCACCTGAGAGCTTCTTC
AAGGGCTGTGTTCTGGACGTCTGCATGGGTGGTGGGGACCATGACATTCTTTGCAAGGCTCTGGCTTCCTACGTGGC
CGCCTGCCAGGCCGCTGGGGTTGTCATCGAAGACTGGCGGGCACAGGTTGGCTGTGAGATCACCTGCCCAGAAAACA
GCCACTATGAGGTCTGTGGCCCACCCTGCCCGGCCAGCTGTCCGTCCCCTGCACCCCTTACGACGCCAGCCGTATGT
GAGGGCCCCTGTGTGGAGGGCTGCCAGTGCGACGCGGGTTTCGTGTTAAGTGCTGACCGCTGTGTTCCCCTCAACAA

FIGURE 57C

CGGCTGCGGCTGCTGGGCCAATGGCACCTACCACGAGGCGGGCAGTGAGTTTTGGGCTGATGGCACCTGCTCCCAGT
GGTGTCGCTGCGGGCCTGGGGGTGGCTCGCTGGTCTGCACACCTGCCAGCTGTGGGCTGGGTGAAGTGTGTGGCCTC
CTGCCATCCGGCCAGCACGGCTGCCAGCCCGTCAGCACAGCTGAGTGCCAGGCGTGGGGTGACCCCCATTACGTCAC
TCTGGATGGGCACCGATTCGATTTCCAAGGCACCTGCGAGTACCTGCTGAGTGCACCCTGCCACGGACCACCCTTGG
GGGCTGAGAACTTCACTGTCACTGTAGCCAATGAGCACCGGGGCAGCCAGGCTGTCAGCTACACCCGCAGTGTCACC
CTGCAAATCTACAACCACAGCCTGACACTGAGTGCCCGCTGGCCCCGGAAGCTACAGGTGGACGGCGTGTTCGTCAC
TCTGCCCTTCCAGCTGGACTCGCTCCTGCACGCACACCTGAGCGGCGCCGACGTGGTGGTGACCACAACCTCAGGGC
TCTCGCTGGCTTTCGACGGGGACAGCTTCGTGCGCCTGCGCGTGCCGGCGGCGTACGCGGGCTCTCTCTGTGGCTTA
TGCGGGAACTACAACCAGGACCCCGCAGACGACCTGAAGGCGGTGGGCGGGAAGCCCGCCGGATGGCAGGTGGGCGG
CGCCCAGGGCTGCGGGGAATGTGTGTCCAAGCCATGCCCGTCGCCGTGCACCCCAGAGCAGCAAGAGTCCTTCGGCG
GCCCGGACGCCTGCGGCGTGATCTCCGCCACCGACGGCCCGCTGGCGCCCTGCCACGGCCTTGTGCCGCCCGCGCAG
TACTTCCAGGGCTGCTTGCTGGACGCCTGCCAAGTTCAGGGCCATCCTGGAGGCCTCTGTCCTGCAGTGGCCACCTA
CGTGGCAGCCTGTCAGGCCGCTGGGGCCCAGCTCCGCGAGTGGAGGCGGCCGGACTTCTGTCCCTTCCAGTGCCCTG
CCCACAGCCACTACGAGCTCTGCGGTGACTCCTGTCCTGGGAGCTGCCCGAGCCTGTCGGCACCCGAGGGCTGTGAG
TCGGCCTGCCGTGAAGGCTGTGTCTGCGATGCTGGCTTCGTGCTCAGTGGTGACACGTGTGTACCTGTGGGCCAGTG
TGGCTGCCTCCACGATGACCGCTACTACCCACTGGGCCAGACCTTCTACCCTGGCCCTGGGTGTGATTCCCTTTGCC
GCTGCCGGGAGGGCGGTGAGGTGTCCTGTGAGCCCTCCAGCTGCGGCCCGCATGAGACCTGCCGGCCATCCGGTGGC
AGCTTGGGCTGCGTGGCCGTGGGCTCTACCACCTGCCAGGCGTCGGGAGATCCCCACTACACCACCTTCGATGGCCG
CCGCTTCGACTTCATGGGCACCTGCGTGTATGTGCTGGCTCAGACCTGCGGCACCCGGCCTGGCCTACATCGGTTTG
CCGTCCTGCAGGAGAACGTGGCCTGGGGTAATGGGCGAGTCAGTGTGACCAGGGTGATCACGGTCCAGGTGGCAAAC
TTCACCCTGCGGCTGGAGCAGAGACAGTGGAAGGTCACGGTGAACGGTGTGGACATGAAGCTGCCCGTGGTGCTGGC
CAACGGCCAGATCCGTGCCTCCCAGCATGGTTCAGATGTTGTGATTGAGACCGACTTCGGCCTGCGTGTGGCCTACG
ACCTTGTGTACTATGTGCGGGTCACCGTCCCTGGAAACTACTACCAGCTGATGTGTGGCCTGTGTGGGAACTACAAC
GGCGACCCCAAGGATGACTTCCAGAAGCCCAATGGCTCGCAGGCAGGCAACGCCAATGAGTTCGGCAACTCCTGGGA
GGAGGTGGTGCCCGACTCTCCCTGCCTGCCGCCGCCCACCTGCCCGCCGGGGAGCGAGGGCTGTATCCCCAGCGAGG
AGTGTCCTCCCGAGCTGGAGAAGAAGTATCAGAAGGAGGAGTTCTGTGGGCTCCTCTCCAGCCCCACAGGGCCACTG
TCCTCCTGCCACAAGCTGGTGGATCCCCAGGGTCCCTTGAAAGATTGCATCTTTGATCTCTGCCTGGGTGGTGGGAA
CCTGAGCATTCTCTGCAGCAACATCCATGCCTACGTGAGTGCTTGCCAGGCGGCTGGAGGCCACGTGGAGCCCTGGA
GGAATGAAACTTTCTGTCCCATGGAATGCCCTCAGAACAGTCACTACGAGCTCTGTGCGGACACCTGCTCCCTGGGC
TGCTCGGCTCTCAGTGCCCCTCTGCAGTGCCCAGATGGGTGTGCTGAGGGCTGCCAGTGTGACTCCGGCTTCCTCTA
CAACGGCCAAGCCTGCGTGCCCATCCAGCAATGTGGCTGCTACCACAATGGTGTCTACTATGAGCCGGAGCAGACAG
TCCTCATTGACAACTGTCGGCAGCAGTGCACGTGCCATGTGGGTAAAGTCGTGGTGTGCCAGGAACACAGCTGCAAG
CCGGGGCAGGTGTGCCAGCCCTCCGGAGGCATCCTGAGCTGCGTCAACAAAGACCCGTGCCACGGCGTGACATGCCG
GCCACAGGAGACATGCAAGGAGCAGGGTGGCCAGGGTGTGTGCCTGCCCAACTATGAGGCCACGTGCTGGCTGTGGG
GCGACCCACACTACCACTCCTTCGATGGCCGGAAGTTTGACTTCCAGGGCACCTGTAACTATGTGCTGGCAACAACT
GGCTGCCCGGGGGTCAGCACCCAGGGCCTGACACCCTTCACCGTCACCACCAAGAACCAGAACCGGGGCAACCCTGC
TGTATCCTACGTGAGAGTCGTCACCGTGGCTGCCCTCGGCACCAACATCTCCATCCACAAGGACGAGATCGGCAAAG
TCCGGGTGAACGGTGTGCTCACAGCCTTGCCTGTCTCCGTGGCCGACGGGCGGATTTCAGTGGCCCAGGGTGCATCG
AAGGCACTGCTGGTGGCTGACTTTGGACTGCAAGTCAGCTATGACTGGAACTGGCGGGTAGACGTGACGCTCCCCAG
CAGCTATCATGGCGCAGTGTGCGGGCTCTGCGGTAACATGGACCGCAACCCCAACAATGACCAGGTCTTCCCTAATG
GCACACTGGCTCCCTCCATACCCATCTGGGGCGGCAGCTGGCGAGCCCCAGGCTGGGACCCACTGTGTTGGGACGAA
TGTCGGGGGTCCTGCCCAACGTGCCCTGAGGACCGGTTGGAGCAGTACGAGGGGCCTGGCTTCTGCGGACCCCTGGC
ATCTGGCACAGGGGGCCCCTTCACCACCTGCCATGCTCATGTGCCACCTGAGAGCTTCTTCAAGGGCTGTGTTCTGG
ACGTCTGCATGGGTGGTGGGGACCATGACATTCTTTGCAAGGCTCTGGCTTCCTACGTGGCCGCCTGCCAGGCCGCT
GGGGTTGTCATCGAAGACTGGCGGGCACAGGTTGGCTGTGAGATCACCTGCCCAGAAAACAGCCACTATGAGGTCTG
TGGCCCACCCTGCCCGGCCAGCTGTCCGTCCCCTGCACCCCTTACGACGCCAGCCGTATGTGAGGGCCCCTGTGTGG
AGGGCTGCCAGTGCGACGCGGGTTTCGTGTTAAGTGCTGACCGCTGTGTTCCCCTCAACAACGGCTGCGGCTGCTGG
GCCAATGGCACCTACCACGAGGCGGGCAGTGAGTTTTGGGCTGATGGCACCTGCTCCCAGTGGTGTCGCTGCGGGCC
TGGGGGTGGCTCGCTGGTCTGCACACCTGCCAGCTGTGGGCTGGGTGAAGTGTGTGGCCTCCTGCCATCCGGCCAGC
ACAGCTGCCAGCCCGTCAGCACAGCTGAGTGCCAGGCGTGGGGTGACCCCCATTACGTCACTCTGGATGGGCACCGA
TTCGATTTCCAAGGCACCTGCGAGTACCTGCTGAGTGCACCCTGCCACGGACCACCCTTGGGGGCTGAGAACTTCAC
TGTCACTGTAGCCAATGAGCACCGGGGCAGCCAGGCTGTCAGCTACACCCGCAGTGTCACCCTGCAAATCTACAACC
ACAGCCTGACACTGAGTGCCCGCTGGCCCCGGAAGCTACAGGTCGACGGCGTGTTCGTGGCTCTGCCTTTCCAGCTG
GACTCGCTCCTGCACGCACACCTGAGCGGCGCCGACGTGGTGGTGACCACAACCTCAGGGCTCTCGCTGGCTTTCGA
TGGGGACAGCTTCGTGCGCCTGCGCGTGCCGGCGGCGTACGCGGCCTCTCTCTGTGGCTTATGCGGGAACTACAACC
AGGACCCCGCAGACGACCTGAAGGCTGTGGGCGGGAAGCCCGCTGGATGGCAGGTGGGCGGGGCCCAGGGCTGCGGG
GAATGTGTGTCCAAGCCATGCCCGTCGCCGTGCACCCCAGAGCAGCAGGAGTCCTTCGGCGGCCCGGACGCCTGCGG
CGTGATCTCCGCCACCGACGGCCCGCTGGCACCCTGCCACGGCCTTGTGCCGCCCGCGCAGTACTTCCAGGGCTGCT
TGCTGGACGCCTGCCAAGTTCAGGGCCATCCTGGAGGCCTCTGTCCTGCAGTGGCTACCTACGTGGCAGCCTGTCAG
GCCGCTGGGGCCCAGCTCGGCGAGTGGAGGCGGCCGGACTTCTGTCCCTTGCAGTGCCCTGCCCACAGCCACTATGA
GCTCTGCGGTGACTCCTGCCCTGTGAGCTGCCCGAGCCTCTCAGCACCCGAGGGCTGTGAGTCGGCCTGCCGTGAAG
GCTGTGTCTGCGATGCTGGCTTCGTACTCAGTGGTGACACCTGCGTACCCGTGGGCCAGTGTGGCTGCCTCCATGAT
GGCCGCTACTACCCACTGGGCGAGGTCTTCTACCCGGGCCCTGAGTGTGAGCGACGCTGTGAGTGTGGCCAGGTGG

FIGURE 57D

CCATGTCACCTGCCAGGAGGGCGCAGCCTGTGGGCCCCATGAGGAGTGCCGGTTAGAGGATGGTGTCCAGGCCTGTC
ATGCCACAGGCTGTGGCCGCTGCCTGGCCAACGGGGGCATCCACTACATCACCCTTGATGGCCGTGTCTACGACCTG
CATGGCTCCTGCTCCTATGTCTTGGCCCAAGTCTGCCACCCAAAGCCTGGGGACGAGGACTTTTCCATCGTGCTTGA
GAAGAATGCAGCTGGACATCTCCAACGCCTCCTGGTTACTGTGGCTGGCCAGGTTGTGAGCCTAGCTCAGGGGCAGC
AGGTCACCGTGGACGGCGAGGCTGTGGCCCTGCCTGTGGCTGTGGGCCGCGTGCGGGTGACCGCCGAGGGCCGAAAC
ATGGTTCTGCAGACGACCAAGGGGCTGCGGCTTCTCTTTGATGGCGATGCCCACCTCCTCATGTCCATCCCCAGCCC
CTTCCGTGGACGGCTCTGTGGCCTCTGTGGGAACTTCAATGGCAACTGGAGTGACGACTTTGTCCTGCCCAATGGCT
CAGCAGCGTCCAGTGTGGAGACCTTCGGGGCTGCATGGCGGGTGCCCGGCTCCTCCAAGGGCTGTGGCGAGGGCTGC
GGGCCCCAAGGCTGCCCAGTGTGCTTGGCAGAGGAGACTGCACCCTATGAGAGCAACGAGGCCTGCGGGCAGCTCCG
GAACCCCCAGGGCCCCTTCGCGACCTGCCAGGCGGTGCTGAGTCCCTCTGAGTACTTCCGCCAATGCGTATACGACC
TGTGCGCGCAAAAGGGTGACAAAGCCTTCCTGTGCCGCAGCCTGGCAGCCTACACGGCGGCCTGTCAGGCAGCTGGC
GTGGCCGTGAAGCCCTGGAGGACAGACAGCTTCTGCCCGCTCCATTGCCCCGCCCACAGCCACTACTCCATCTGCAC
TCGCACCTGCCAGGGATCCTGTGCGGCTCTCTCCGGCCTCACGGGCTGCACCACCCGCTGTTTTGAGGGCTGTGAGT
GCGACGACCGCTTCCTGCTTTCCCAGGGTGTCTGCATCCCTGTCCAAGATTGTGGCTGCACCCATAATGGCCGATAC
TTGCCGGTAAACTCCTCCCTGCTGACCTCAGACTGCAGCGAGCGCTGTTCCTGTTCCTCAAGCTCTGGCCTGACATG
CCAGGCCGCTGGCTGCCCACCAGGCCGTGTATGTGAGGTCAAGGCTGAAGCCCGGAACTGCTGGGCCACCCGTGGTC
TCTGTGTCCTGTCTGTGGGTGCCAACCTCACCACCTTTGATGGGGCCCGTGGTGCCACCACCTCTCCTGGTGTCTAT
GAGCTCTCTTCCCGCTGCCCAGGACTACAGAATACCATCCCCTGGTACCGTGTAGTTGCCGAAGTCCAGATCTGCCA
TGGCAAAACGGAGGCTGTGGGCCAGGTCCACATCTTCTTCCAGGATGGGATGGTGACGTTGACTCCAAACAAGGGTG
TGTGGGTGAATGGTCTCCGAGTGGATCTCCCAGCTGAGAAGTTAGCATCTGTGTCCGTGAGTCGTACACCTGATGGC
TCCCTGCTAGTCCGCCAGAAGGCAGGGGTCCAGGTGTGGCTTGGAGCCAATGGGAAGGTGGCTGTGATTGTCAGCAA
TGACCATGCTGGGAAACTGTGTGGGGCCTGTGGAAACTTTGACGGGGACCAGACCAATGATTGGCATGACTCCCAGG
AGAAGCCAGCGATGGAGAAATGGAGAGCGCAGGACTTCTCCCCATGTTATGGCTGATCAGTCATCCACCAGGAACGA
AGATTTCCTGAAGAAGACCTGGTCCCTCTGGAGGTTGCGGTGGCTGAAGGATGCATCATGTGCTCCTACCCTGCTCT
ACCGCTTTTCTGGGTCACAGAGGCCAAATGTGAGAGCATTGAATAAATATCTTAAGCT

FIGURE 58

GTGCACTATGGCTCGGGGCTCGCTGCGCCGGTTGCTGCGGCTCCTCGTGCTGGGGCTCTGGCTGGCGTTGCTGCGCT
CCGTGGCCGGGGAGCAAGCGCCAGGCACCGCCCCCTGCTCCCGCGGCAGCTCCTGGAGCGCGGACCTGGACAAGTGC
ATGGACTGCGCGTCTTGCAGGGCGCGACCGCACAGCGACTTCTGCCTGGGCTGCGCTGCAGCACCTCCTGCCCCCTT
CCGGCTGCTTTGGCCCATCCTTGGGGGCGCTCTGAGCCTGACCTTCGTGCTGGGGCTGCTTTCTGGCTTTTTGGTCT
GGAGACGATGCCGCAGGAGAGAGAAGTTCACCACCCCCATAGAGGAGACCGGCGGAGAGGGCTGCCCAGCTGTGGCG
CTGATCCAGTGACAATGTGCCCCCTGCCAGCCGGGGCTCGCCCACTCATCATTCATTCATCCATTCTAGAGCCAGTC
TCTGCCTCCCAGACGCGGCGGGAGCCAAGCTCCTCCAACCACAAGGGGGGTGGGGGCGGTGAATCACCTCTGAGGC
CTGGGCCCAGGGTTCAGGGGAACCTTCCAAGGTGTCTGGTTGCCCTGCCTCTGGCTCCAGAACAGAAAGGGAGCCTC
ACGCTGGCTCACACAAAACAGCTGACACTGACTAAGGAACTGCAGCATTTGCACAGGGGAGGGGGGTGCCCTCCTTC
CTAGAGGCCCTGGGGGCCAGGCTGACTTGGGGGGCAGACTTGACACTAGGCCCCACTCACTCAGATGTCCTGAAATT
CCACCACGGGGGTCACCCTGGGGGGTTAGGGACCTATTTTTAACACTAGGGGGCTGGCCCACTAGGAGGGCTGGCCC
TAAGATACAGACCCCCCCAACTCCCCAAAGCGGGGAGGAGATATTTATTTTGGGGAGAGTTTGGAGGGGAGGGAGAA
TTTATTAATAAAAGAATCTTTAACTTT

FIGURE 59

AGCACTCTCCAGCCTCTCACCGCAAAATTACACACCCCAGTACACCAGCAGAGGAAACTTATAACCTCGGGAGGCGG
GTCCTTCCCCTCAGTGCGGTCACATACTTCCAGAAGAGCGGACCAGGGCTGCTGCCAGCACCTGCCACTCAGAGCGC
CTCTGTCGCTGGGACCCTTCAGAACTCTCTTTGCTCACAAGTTACCAAAAAAAAAAGAGCCAACATGTTGGTATTGC
TGGCTGGTATCTTTGTGGTCCACATCGCTACTGTTATTATGCTATTTGTTAGCACCATTGCCAATGTCTGGTTGGTT
TCCAATACGGTAGATGCATCAGTAGGTCTTTGGAAAAACTGTACCAACATTAGCTGCAGTGACAGCCTGTCATATGC
CAGTGAAGATGCCCTCAAGACAGTGCAGGCCTTCATGATTCTCTCTATCATCTTCTGTGTCATTGCCCTCCTGGTCT
TCGTGTTCCAGCTCTTCACCATGGAGAAGGGAAACCGGTTCTTCCTCTCAGGGGCCACCACACTGGTGTGCTGGCTG
TGCATTCTTGTGGGGGTGTCCATCTACACTAGTCATTATGCGAATCGTGATGGAACGCAGTATCACCACGGCTATTC
CTACATCCTGGGCTGGATCTGCTTCTGCTTCAGCTTCATCATCGGCGTTCTCTATCTGGTCCTGAGAAAGAAATAAG
GCCGGACGAGTTCATGGGGATCTGGGGGTGGGGAGGAGGAAGCCGTTGAATCTGGGAGGGAAGTGGAGGTTGCTGT
ACAGGAAAAACCGAGATAGGGGAGGGGGAGGGGGAAGCAAAGGGGGGAGGTCAAATCCCAAACCATTACTGAGGGG
ATTCTCTACTGCCAAGCCCCTGCCCTGGGGAGAAAGTAGTTGGCTAGTACTTTGATGCTCCCTTGATGGGGTCCAGA
GAGCCTCCCTGCAGCCACCAGACTTGGCCTCCAGCTGTTCTTAGTGACACACACTGTCTGGGGCCCCATCAGCTGCC
ACAACACCAGCCCCACTTCTGGGTCATGCACTGAGGTCCACAGACCTACTGCACTGAGTTAAAATAGCGGTACAAGT
TCTGGCAAGAGCAGATACTGTCTTTGTGCTGAATACGCTAAGCCTGGAAGCCATCCTGCCCTTCTGACCCAAAGCAA
AACATCACATTCCAGTCTGAAGTGCCTACTGGGGGGCTTTGGCCTGTGAGCCATTGTCCCTCTTTGGAACAGATATT
TAGCTCTGTGGAATTCAGTGACAAAATGGGAGGAGGAAAGAGAGTTTGTAAGGTCATGCTGGTGGGTTAGCTAAACC
AAGAAGGAGACCTTTTCACAATGGAAAACCTGGGGGATGGTCAGAGCCCAGTCGAGACCTCACACACGGCTGTCCCT
CATGGAGACCTCATGCCATGGTCTTTGCTAGGCCTCTTGCTGAAAGCCAAGGCAGCTCTTCTGGAGTTTCTCTAAAG
TCACTAGTGAACAATTCGGTGGTAAAAGTACCACACAAACTATGGGATCCAAGGGGCAGTCTTGCAACAGTGCCATG
TTAGGGTTATGTTTTTAGGATTCCCCTCAATGCAGTCAGTGTTTCTTTTAAGTATACAACAGGAGAGAGATGGACAT
GGCTCATTGTAGCACAATCCTATTACTCTTCCTCTAACATTTTTGAGGAAGTTTTGTCTAATTATCAATATTGAGGA
TCAGGGCTCCTAGGCTCAGTGGTAGCTCTGGCTTAGACACCACCTGGAGTGATCACCTCTTGGGGACCCTGCCTATC
CCACTTCACAGGTGAGGCATGGCAATTCTGGAAGCTGATTAAAACACACATAAACCAAAACCAAACAACAGGCCCTT
GGGTGAAAGGTGCTATATAATTGTGAAGTATTAAGCCTACCGTATTTCAGCCATGATAAGAACAGAGTGCCTGCATT
CCCAGGAAAATACGAAAATCCCATGAGATAAATAAAAATATAGGTGATGGGCAGATCTTTTCTTTAAAATAAAAAG
CAAAAACTCTTGTGGTACCTAGTCAGATGGTAGACGAGCTGTCTGCTGCCGCAGGAGCACCTCTATACAGGACTTAG
AAGTAGTATGTTATTCCTGGTTAAGCAGGCATTGCTTTGCCCTGGAGCAGCTATTTTAAGCCATCTCAGATTCTGTC
TAAAGGGGTTTTTGGGAAGACGTTTTCTTTATCGCCCTGAGAAGATCTACCCCAGGGAGAATCTGAGACATCTTGC
CTACTTTTCTTTATTAGCTTTCTCCTCATCCATTTCTTTTATACCTTTCCTTTTTGGGGAGTTGTTATGCCATGATT
TTTGGTATTTATGTAAAAGGATTATTACTAATTCTATTTCTCTATGTTTATTCTAGTTAAGGAAATGTTGAGGGCAA
GCCACCAAATTACCTAGGCTGAGGTTAGAGAGATTGGCCAGCAAAAACTGTGGGAAGATGAACTTTGTCATTATGAT
TTCATTATCACATGATTATAGAAGGCTGTCTTAGTGCAAAAAACATACTTACATTTCAGACATATCCAAAGGAATA
CTCACATTTTGTTAAGAAGTTGAACTATGACTGGAGTAAACCATGTATTCCCTTATCTTTTACTTTTTTTCTGTGAC
ATTTATGTCTCATGTAATTTGCATTACTCTGGTGGATTGTTCTAGTACTGTATTGGGCTTCTTCGTTAATAGATTAT
TTCATATACTATAATTGTAAATATTTTGATACAAATGTTTATAACTCTAGGGATATAAAAACAGATTCTGATTCCCT
TCAAAAAAAAAAAA

FIGURE 60A

CTGCGGCCGGCCCGCGAGCTAGGCTGGGTTTTTTTTTTTCTCCCCTCCCTCCCCCCTTTTTCCATGCAGCTGATCTA
AAAGGGAATAAAAGGCTGCGCATAATCATAATAATAAAAGAAGGGGAGCGCGAGAGAAGGAAAGAAAGCCGGGAGGT
GGAAGAGGAGGGGGAGCGTCTCAAAGAAGCGATCAGAATAATAAAAGGAGGCCGGGCTCTTTGCCTTCTGGAACGGG
CCGCTCTTGAAAGGGCTTTTGAAAAGTGGTGTTGTTTTCCAGTCGTGCATGCTCCAATCGGCGGAGTATATTAGAGC
CGGGACGCGGCGGCCGCAGGGGCAGCGGCGACGGCAGCACCGGCGGCAGCACCAGCGCGAACAGCAGCGGCGGCGTC
CCGAGTGCCCGCGGCGCGCGGCGCAGCGATGCGTTCCCCACGGACGCGCGGCCGGTCCGGGCGCCCCCTAAGCCTCC
TGCTCGCCCTGCTCTGTGCCCTGCGAGCCAAGGTGTGTGGGGCCTCGGGTCAGTTCGAGTTGGAGATCCTGTCCATG
CAGAACGTGAACGGGGAGCTGCAGAACGGGAACTGCTGCGGCGGCGCCCGGAACCCGGGAGACCGCAAGTGCACCCG
CGACGAGTGTGACACATACTTCAAAGTGTGCCTCAAGGAGTATCAGTCCCGCGTCACGGCCGGGGGGCCCTGCAGCT
TCGGCTCAGGGTCCACGCCTGTCATCGGGGGCAACACCTTCAACCTCAAGGCCAGCCGCGGCAACGACCGCAACCGC
ATCGTGCTGCCTTTCAGTTTCGCCTGGCCGAGGTCCTATACGTTGCTTGTGGAGGCGTGGGATTCCAGTAATGACAC
CGTTCAACCTGACAGTATTATTGAAAAGGCTTCTCACTCGGGCATGATCAACCCCAGCCGGCAGTGGCAGACGCTGA
AGCAGAACACGGGCGTTGCCCACTTTGAGTATCAGATCCGCGTGACCTGTGATGACTACTACTATGGCTTTGGCTGC
AATAAGTTCTGCCGCCCCAGAGATGACTTCTTTGGACACTATGCCTGTGACCAGAATGGCAACAAAACTTGCATGGA
AGGCTGGATGGGCCCCGAATGTAACAGAGCTATTTGCCGACAAGGCTGCAGTCCTAAGCATGGGTCTTGCAAACTCC
CAGGTGACTGCAGGTGCCAGTATGGCTGGCAAGGCCTGTACTGTGATAAGTGCATCCCACACCCGGGATGCGTCCAC
GGCATCTGTAATGAGCCCTGGCAGTGCCTCTGTGAGACCAACTGGGGCGGCCAGCTCTGTGACAAAGATCTCAATTA
CTGTGGGACTCATCAGCCGTGTCTCAACGGGGGAACTTGTAGCAACACAGGCCCTGACAAATATCAGTGTTCCTGCC
CTGAGGGGTATTCAGGACCCAACTGTGAAATTGCTGAGCACGCCTGCCTCTCTGATCCCTGTCACAACAGAGGCAGC
TGTAAGGAGACCTCCCTGGGCTTTGAGTGTGAGTGTTCCCCAGGCTGGACCGGCCCCACATGCTCTACAAACATTGA
TGACTGTTCTCCTAATAACTGTTCCCACGGGGGCACCTGCCAGGACCTGGTTAACGGATTTAAGTGTGTGTGCCCCC
CACAGTGGACTGGGAAAACGTGCCAGTTAGATGCAAATGAATGTGAGGCCAAACCTTGTGTAAACGCCAAATCCTGT
AAGAATCTCATTGCCAGCTACTACTGCGACTGTCTTCCCGGCTGGATGGGTCAGAATTGTGACATAAATATTAATGA
CTGCCTTGGCCAGTGTCAGAATGACGCCTCCTGTCGGGATTTGGTTAATGGTTATCGCTGTATCTGTCCACCTGGCT
ATGCAGGCGATCACTGTGAGAGAGACATCGATGAATGTGCCAGCAACCCCTGTTTGAATGGGGGTCACTGTCAGAAT
GAAATCAACAGATTCCAGTGTCTGTGTCCCACTGGTTTCTCTGGAAACCTCTGTCAGCTGGACATCGATTATTGTGA
GCCTAATCCCTGCCAGAACGGTGCCCAGTGCTACAACCGTGCCAGTGACTATTTCTGCAAGTGCCCCGAGGACTATG
AGGGCAAGAACTGCTCACACCTGAAAGACCACTGCCGCACGACCCCCTGTGAAGTGATTGACAGCTGCACAGTGGCC
ATGGCTTCCAACGACACACCTGAAGGGGTGCGGTATATTTCCTCCAACGTCTGTGGTCCTCACGGAAGTGCAAGAG
TCAGTCGGGAGGCAAATTCACCTGTGACTGTAACAAAGGCTTCACGGGAACATACTGCCATGAAAATATTAATGACT
GTGAGAGCAACCCTTGTAGAAACGGTGGCACTTGCATCGATGGTGTCAACTCCTACAAGTGCATCTGTAGTGACGGC
TGGGAGGGGGCCTACTGTGAAACCAATATTAATGACTGCAGCCAGAACCCCTGCCACAATGGGGGCACGTGTCGCGA
CCTGGTCAATGACTTCTACTGTGACTGTAAAAATGGGTGGAAAGGAAAGACCTGCCACTCACGTGACAGTCAGTGTG
ATGAGGCCACGTGCAACAACGGTGGCACCTGCTATGATGAGGGGGATGCTTTTAAGTGCATGTGTCCTGGCGGCTGG
GAAGGAACAACCTGTAACATAGCCCGAAACAGTAGCTGCCTGCCCAACCCCTGCCATAATGGGGGCACATGTGTGGT
CAACGGCGAGTCCTTTACGTGCGTCTGCAAGGAAGGCTGGGAGGGGCCCATCTGTGCTCAGAATACCAATGACTGCA
GCCCTCATCCCTGTTACAACAGCGGCACCTGTGTGGATGGAGACAACTGGTACCGGTGCGAATGTGCCCCGGGTTTT
GCTGGGCCCGACTGCAGAATAAACATCAATGAATGCCAGTCTTCACCTTGTGCCTTTGGAGCGACCTGTGTGGATGA
GATCAATGGCTACCGGTGTGTCTGCCCTCCAGGGCACAGTGGTGCCAAGTGCCAGGAAGTTTCAGGGAGACCTTGCA
TCACCATGGGGAGTGTGATACCAGATGGGGCCAAATGGGATGATGACTGTAATACCTGCCAGTGCCTGAATGGACGG
ATCGCCTGCTCAAAGGTCTGGTGTGGCCCTCGACCTTGCCTGCTCCACAAAGGGCACAGCGAGTGCCCCAGCGGGCA
GAGCTGCATCCCCATCCTGGACGACCAGTGCTTCGTCCACCCCTGCACTGGTGTGGGCGAGTGTCGGTCTTCCAGTC
TCCAGCCGGTGAAGACAAAGTGCACCTCTGACTCCTATTACCAGGATAACTGTGCGAACATCACATTTACCTTTAAC
AAGGAGATGATGTCACCAGGTCTTACTACGGAGCACATTTGCAGTGAATTGAGGAATTTGAATATTTTGAAGAATGT
TTCCGCTGAATATTCAATCTACATCGCTTGCGAGCCTTCCCCTTCAGCGAACAATGAAATACATGTGGCCATTTCTG
CTGAAGATATACGGATGATGGGAACCCGATCAAGGAAATCACTGACAAAATAATCGATCTTGTTAGTAAACGTGAT
GGAAACAGCTCGCTGATTGCTGCCGTTGCAGAAGTAAGAGTTCAGAGGCGGCCTCTGAAGAACAGAACAGATTTCCT
TGTTCCCTTGCTGAGCTCTGTCTTAACTGTGGCTTGGATCTGTTGCTTGGTGACGGCCTTCTACTGGTGCCTGCGGA
AGCGGCGGAAGCCGGGCAGCCACACACACTCAGCCTCTGAGGACAACACCACCAACAACGTGCGGGAGCAGCTGAAC
CAGATCAAAAACCCCATTGAGAAACATGGGGCCAACACGGTCCCCATCAAGGATTACGAGAACAAGAACTCCAAAAT
GTCTAAAATAAGGACACACAATTCTGAAGTAGAAGAGGACGACATGGACAAACACCAGCAGAAAGCCCGGTTTGCCA
AGCAGCCGGCGTATACGCTGGTAGACAGAGAAGAGAAGCCCCCCAACGGCACGCCGACAAAACACCCAAACTGGACA
AACAAACAGGACAACAGAGACTTGGAAAGTGCCCAGAGCTTAAACCGAATGGAGTACATCGTATAGCAGACCGCGGG
CACTGCCGCCGCTAGGTAGAGTCTGAGGGCTTGTAGTTCTTTAAACTGTCGTGTCATACTCGAGTCTGAGGCCGTTG
CTGACTTAGAATCCCTGTGTTAATTTAAGTTTTGACAAGCTGGCTTACACTGGCAATGGTAGTTTCTGTGGTTGGCT
GGGAAATCGAGTGCCGCATCTCACAGCTATGCAAAAAGCTAGTCAACAGTACCCTGGTTGTGTGTCCCCTTGCAGCC
GACACGGTCTCGGATCAGGCTCCCAGGAGCCTGCCCAGCCCCCTGGTCTTTGAGCTCCCACTTCTGCCAGATGTCCT
AATGGTGATGCAGTCTTAGATCATAGTTTTATTTATATTTATTGACTCTTGAGTTGTTTTTGTATATTGGTTTTATG
ATGACGTACAAGTAGTTCTGTATTTGAAAGTGCCTTTGCAGCTCAGAACCACAGCAACGATCACAAATGACTTTATT
ATTTATTTTTTTAATTGTATTTTTGTTGTTGGGGGAGGGGAGACTTTGATGTCAGCAGTTGCTGGTAAAATGAAGAA
TTTAAAGAAAAAAATGTCAAAAGTAGAACTTTGTATAGTTATGTAAATAATTCTTTTTTATTAATCACTGTGTATAT
TTGATTTATTAACTTAATAATCAAGAGCCTTAAAACATCATTCCTTTTTATTTATATGTATGTGTTTAGAATTGAG

FIGURE 60B

GTTTTTGATAGCATTGTAAGCGTATGGCTTTATTTTTTTGAACTCTTCTCATTACTTGTTGCCTATAAGCCAAAATT
AAGGTGTTTGAAAATAGTTTATTTTAAAACAATAGGATGGGCTTCTGTGCCCAGAATACTGATGGAATTTTTTTTGT
ACGACGTCAGATGTTTAAAACACCTTCTATAGCATCACTTAAAACACGTTTTAAGGACTGACTGAGGCAGTTTGAGG
ATTAGTTTAGAACAGGTTTTTTTGTTTGTTTGTTTTTTGTTTTTCTGCTTTAGACTTGAAAAGAGACAGGCAGGTGA
TCTGCTGCAGAGCAGTAAGGGAACAAGTTGAGCTATGACTTAACATAGCCAAAATGTGAGTGGTTGAATATGATTAA
AAATATCAAATTAATTGTGTGAACTTGGAAGCACACCAATCTGACTTTGTAAATTCTGATTTCTTTTCACCATTCGT
ACATAATACTGAACCACTTGTAGATTTGATTTTTTTTTTAATCTACTGCATTTAGGGAGTATTCTAATAAGCTAGTT
GAATACTTGAACCATAAAATGTCCAGTAAGATCACTGTTTAGATTTGCCATAGAGTACACTGCCTGCCTTAAGTGAG
GAAATCAAAGTGCTATTACGAAGTTCAAGATCAAAAAGGCTTATAAAACAGAGTAATCTTGTTGGTTCACCATTGAG
ACCGTGAAGATACTTTGTATTGTCCTATTAGTGTTATATGAACATACAAATGCATCTTTGATGTGTTGTTCTTGGCA
ATAAATTTTGAAAAGTAATATTTATTAAATTTTTTTGTATGAAAACATGGAACAGTGTGGCTCTTCTGAGCTTACGT
AGTTCTACCGGCTTTGCCGTGTGCTTCTGCCACCCTGCTGAGTCTGTTCTGGTAATCGGGGTATAATAGGCTCTGCC
TGACAGAGGGATGGAGGAAGAACTGAAAGGCTTTTCAACCACAAAACTCATCTGGAGTTCTCAAAGACCTGGGGCTG
CTGTGAAGCTGGAACTGCGGGAGCCCCATCTAGGGGAGCCTTGATTCCCTTGTTATTCAACAGCAAGTGTGAATACT
GCTTGAATAAACACCACTGGATTAATGGAAAAAAAAAAAAAAAA

FIGURE 61

GGACAAAAGGGTGAAAGAGGCCTCCCGGGGTTACAAGGTGTCATTGGGTTTCCTGGAATGCAAGGACCTGAGGGGCC
ACAGGGACCACCAGGACAAAAGGGTGATACTGGAGAACCAGGACTACCTGGAACAAAAGGGACAAGAGGACCTCCGG
GAGCATCTGGCTACCCTGGAAACCCAGGACTTCCCGGAATTCCTGGCCAAGACGGCCCGCCAGGCCCCCCAGGTATT
CCAGGATGCAATGGCACAAAGGGGGAGAGAGGGCCGCTCGGGCCTCCTGGCTTGCCTGGTTTCGCAGGAAACCCCGG
ACCACCAGGCTTACCAGGGATGAAGGGTGATCCAGGTGAGATACTTGGCCATGTGCCCGGGATGCTGTTGAAAGGTG
AAAGAGGATTTCCCGGAATCCCAGGGACTCCAGGCCCACCAGGACTGCCAGGGCTTCAAGGTCCTGTTGGGCCTCCA
GGATTTACCGGACCACCAGGTCCCCCAGGCCCTCCCGGCCCTCCAGGTGAAAAGGGACAAATGGGCTTAAGTTTTCA
AGGACCAAAAGGTGACAAGGGTGACCAAGGGGTCAGTGGGCCTCCAGGAGTACCAGGACAAGCTCAAGTTCAAGAAA
AAGGAGACTTCGCCACCAAGGGAGAAAAGGGCCAAAAAGGTGAACCTGGATTTCAGGGGATGCCAGGGGTCGGAGAG
AAAGGTGAACCCGGAAAACCAGGACCCAGAGGCAAACCCGGAAAAGATGGTGACAAAGGGGAAAAAGGGAGTCCCGG
TTTTCCTGGTGAACCCGGGTACCCAGGACTCATAGGCCGCCAGGGCCCGCAGGGAGAAAAGGGTGAAGCAGGTCCTC
CTGGCCCACCTGGAATTGTTATAGGCACAGGACCTTTGGGAGAAAAAGGAGAGAGGGGCTACCCTGGAACTCCGGGG
CCAAGAGGAGAGCCAGGCCCAAAAGGTTTCCCAGGACTACCAGGCCAACCCGGACCTCCAGGCCTCCCTGTACCTGG
GCAGGCTGGTGCCCCTGGCTTCCCTGGTGAAAGAGGAGAAAAAGGTGACCGAGGATTTCCTGGTACATCTCTGCCAG
GACCAAGTGGAAGAGATGGGCTCCCGGGTCCTCCTGGTTCCCCTGGGCCCCCTGGGCAGCCTGGCTACACAAATGGA
ATTGTGGAATGTCAGCCCGGACCTCCAGGTGACCAGGGTCCTCCTGGAATTCCAGGGCAGCCAGGATTTATAGGCGA
AATTGGAGAGAAAGGTCAAAAAGGAGAGAGTTGCCTCATCTGTGATATAGACGGATATCGGGGGCCTCCCGGGCCAC
AGGGACCCCCGGGAGAAATAGGTTTCCCAGGGCAGCCAGGGGCCAAGGGCGACAGAGGTTTGCCTGGCAGAGATGGT
GTTGCAGGAGTGCCAGGCCCTCAAGGTACACCAGGGCTGATAGGCCAGCCAGGAGCCAAGGGGGAGCCTGGTGAGTT
TTATTTCGACTTGCGGCTCAAAGGTGACAAAGGAGACCCAGGCTTTCCAGGACAGCCCGGCATGCCAGGGAGAGCGG
GTTCTCCTGGAAGAGATGGCCATCCGGGTCTTCCTGGCCCCAAGGGCTCGCCGGGTTCTGTAGGATTGAAAGGAGAG
CGTGGCCCCCCTGGAGGAGTTGGATTCCCAGGCAGTCGTGGTGACACCGGCCCCCCTGGGCCTCCAGGATATGGTCC
TGCTGGTCCCATTGGTGACAAAGGACAAGCAGGCTTTCCTGGAGGCCCTGGATCCCCAGGCCTGCCAGGTCCAAAGG
GTGAACCAGGAAAAATTGTTCCTTTACCAGGCCCCCCTGGAGCAGAAGGACTGCCGGGGTCCCCAGGCTTCCCAGGT
CCCCAAGGAGACCGAGGCTTTCCCGGAACCCCAGGAAGGCCAGGCCTGCCAGGAGAGAAGGGCGCTGTGGGCCAGCC
AGGCATTGGATTTCCAGGGCCCCCCGGCCCCAAAGGTGTTGACGGCTTACCTGGAGACATGGGGCCACCGGGGACTC
CAGGTCGCCCGGGATTTAATGGCTTACCTGGGAACCCAGGTGTGCAGGGCCAGAAGGGAGAGCCTGGAGTTGGTCTA
CCGGGACTCAAAGGTTTGCCAGGTCTTCCCGGCATTCCTGGCACACCCGGGGAGAAGGGGAGCATTGGGGTACCAGG
CGTTCCTGGAGAACATGGAGCGATCGGACCCCCTGGGCTTCAGGGGATCAGAGGTGAACCGGGACCTCCTGGATTGC
CAGGCTCCGTGGGGTCTCCAGGAGTTCCAGGAATAGGCCCCCCTGGAGCTAGGGGTCCCCCTGGAGGACAGGGACCA
CCGGGGTTGTCAGGCCCTCCTGGAATAAAAGGAGAGAAGGGTTTCCCCGGATTCCCTGGACTGGACATGCCGGGCCC
TAAAGGAGATAAAGGGGCTCAAGGACTCCCTGGCATAACGGGACAGTCGGGGCTCCCTGGCCTTCCTGGACAGCAGG
GGGCTCCTGGGATTCCTGGGTTTCCAGGTTCCAAGGGAGAAATGGGCGTCATGGGGACCCCCGGGCAGCCGGGCTCA
CCAGGACCATGGGGTGCTCCTGGATTACCGGGTGAAAAAGGGGACCATGGCTTTCCGGGCTCCTCAGGACCCAGGGG
AGACCCTGGCTTGAAAGGTGATAAGGGGGATGTCGGTCTCCCTGGCAAGCCTGGCTCCATGGATAAGGTGGACATGG
GCAGCATGAAGGGCCAGAAAGGAGACCAAGGAGAGAAAGGACAAATTGGACCAATTGGTGAGAAGGGATCCCGAGGA
GACCCTGGGACCCCAGGAGTGCCTGGAAAGGACGGGCAGGCAGGACAGCCTGGGCAGCCAGGACCTAAAGGTGATCC
AGGTATAAGTGGAACCCCAGGTGCTCCAGGACTTCCGGGACCAAAAGGATCTGTTGGTGGAATGGGCTTGCCAGGAA
CACCTGGAGAGAAAGGTGTGCCTGGCATCCCTGGCCCACAAGGTTCACCTGGCTTACCTGGAGACAAAGGTGCAAAA
GGAGAGAAAGGGCAGGCAGGCCCACCTGGCATAGGCATCCCAGGGCTGCGAGGTGAAAAGGGAGATCAAGGGATAGC
GGGTTTCCCAGGAAGCCCTGGAGAGAAGGGAGAAAAAGGAAGCATTGGGATCCCAGGAATGCCAGGGTCCCCAGGCC
TTAAAGGGTCTCCCGGGAGTGTTGGCTATCCAGGAAGTCCTGGGCTACCTGGAGAAAAAGGTGACAAAGGCCTCCCA
GGATTGGATGGCATCCCTGGTGTCAAAGGAGAAGCAGGTCTTCCTGGGACTCCTGGCCCCACAGGCCCAGCTGGCCA
GAAAGGGGAGCCAGGCAGTGATGGAATCCCGGGGTCAGCAGGAGAGAAGGGTGAACCAGGTCTACCAGGAAGAGGAT
TCCCAGGGTTTCCAGGGGCCAAAGGAGACAAAGGTTCAAAGGGTGAGGTGGGTTTCCCAGGATTAGCCGGGAGCCCA
GGAATTCCTGGATCCAAAGGAGAGCAAGGATTCATGGGTCCTCCGGGGCCCCAGGGACAGCCGGGGTTACCGGGATC
CCCAGGCCATGCAACGGAGGGGCCCAAAGGAGACCGCGGACCTCAGGGCCAGCCTGGCCTGCCAGGACTTCCGGGAC
CCATGGGGCCTCCAGGG

FIGURE 62

GGGGAACGAGGCCCACCTGGGAGCCCAGGACTTCAGGGGTTCCCAGGCATCACACCCCCTTCCAACATCTCTGGGGC
ACCTGGTGACAAAGGGGCGCCAGGGATATTTGGCCTGAAAGGTTATCGGGGCCCACCAGGGCCACCAGGTTCTGCTG
CTCTTCCTGGAAGCAAAGGTGACACAGGGAACCCAGGAGCTCCAGGAACCCCAGGGACCAAAGGATGGGCCGGGGAC
TCCGGGCCCCAGGGCAGGCCTGGTGTGTTTGGTCTCCCAGGAGAAAAAGGGCCCAGGGGTGAACAAGGCTTCATGGG
GAACACTGGACCCACCGGGGCGGTGGGCGACAGAGGCCCCAAGGGACCCAAGGGAGACCCAGGATTCCCTGGTGCCC
CCGGGACTGTGGGAGCCCCCGGGATTGCAGGAATCCCCCAGAAGATTGCCATCCAACCAGGGACAGTGGGTCCCCAG
GGGAGGCGAGGCCCCCCTGGGGCACCGGGGGAGATCGGGCCCCAGGGCCCCCCCGGAGAACCAGGTTTTCGTGGGGC
TCCAGGGAAAGCTGGGCCCCAAGGAAGAGGTGGTGTGTCTGCTGTTCCCGGCTTCCGGGGAGATGAAGGACCCATAG
GCCACCAGGGGCCGATTGGCCAAGAAGGTGCACCAGGCCGTCCAGGGAGCCCGGGCCTGCCGGGTATGCCAGGCCGC
AGCGTCAGCATCGGCTACCTCCTGGTGAAGCACAGCCAGACGGACCAGGAGCCCATGTGCCCGGTGGGCATGAACAA
ACTCTGGAGTGGATACAGCCTGCTGTACTTCGAGGGCCAGGAGAAGGCGCACAACCAGGACCTGGGGCTGGCGGGCT
CCTGCCTGGCGCGGTTCAGCACCATGCCCTTCCTGTACTGCAACCCTGGTGATGTCTGCTACTATGCCAGCCGGAAC
GACAAGTCCTACTGGCTCTCTACCACTGCGCCGCTGCCCATGATGCCCGTGGCCGAGGACGAGATCAAGCCCTACAT
CAGCCGCTGTTCTGTGTGTGAGGCCCCGGCCATCGCCATCGCGGTCCACAGTCAGGATGTCTCCATCCCACACTGCC
CAGCTGGGTGGCGGAGTTTGTGGATCGGATATTCCTTCCTCATGCACACGGCGGCGGGAGACGAAGGCGGTGGCCAA
TCACTGGTGTCACCGGGCAGCTGTCTAGAGGACTTCCGCGCCACACCATTCATCGAATGCAATGGAGGCCGCGGCAC
CTGCCACTACTACGCCAACAAGTACAGCTTCTGGCTGACCACCATTCCCGAGCAGAGCTTCCAGGGCTCGCCCTCCG
CCGACACGCTCAAGGCCGGCCTCATCCGCACACACATCAGCCGCTGCCAGGTGTGCATGAAGAACCTGTGAGCCGGC
GCGTGCCAGGAAGGGCCATTTTGGTGCTTATTCTTAACTTATTACCTCAGGTGCCAACCAAAAATTGGTTTTATTTT
TTTCTTAAAAAAAAAAAAAAGTCTACCAAAGGAATTTGCATCCAGCAGCAGCACTTAGACCTGCCAGCCACTGTCAC
CGAGCGGGTGCAAGCACTCGGGGTCCCTGGAGGCAAGCCCTGCCCACAGAAAGCCAGGAGCAGCCCTGGCCCCCATC
AGCCCTGCTACGACGCACCGCCTGAAGGCACAGCTAACCACTTCGCACACACCCATGTAACCACTGCACTTTCCAAT
GCCACAGACAACTCACATTGTTCAACTCCTTCTCGGGGTGGGACAGACGAGACAACAGCACACAGGCAGCCAGCCGT
GGCCAGAGGCTCGAGGGGCTCAGGGGCTCAGGCACCCGTCCCCACACGAGGGCCCCGTGGGTGGCCTGGCCCTGCTT
TCTACGCCAATGTTATGCCAGCTCCATGTTCTCCCAAATACCGTTGATGTGAATTATTTTAAAGGCAAAACTGTGCT
CTTTATTTTAAAAAACACTGATAATCACACTGCGGTAGGTCATTCTTTTGCCACATCCCTATAGACCACTGGGTTTG
GCAAAACTCAGGCAGAAGTGGAGACCTTTCTAGACATCATTGTCAGCCTTGCTACTTGAAGGTACACCCCATAGGGT
CGGAGGTGCTGTCCCCACTGCCCCACCTTGTCCCTGAGATTTAACCCCTCCACTGCTGGGGGTGAGCTGTACTCTTC
TGACTGCCCCCTCCTGTGTAACGACTACAAAATAAAACTTGGTTCTGAATATTTTT

FIGURE 63A

AGCAGACGGGAGTTTCTCCTCGGGGTCGGAGCAGGAGGCACGCGGAGTGTGAGGCCACGCATGAGCGGACGCTAACC
CCCTCCCCAGCCACAAAGAGTCTACATGTCTAGGGTCTAGACATGTTCAGCTTTGTGGACCTCCGGCTCCTGCTCCT
CTTAGCGGCCACCGCCCTCCTGACGCACGGCCAAGAGGAAGGCCAAGTCGAGGGCCAAGACGAAGACATCCCACCAA
TCACCTGCGTACAGAACGGCCTCAGGTACCATGACCGAGACGTGTGGAAACCCGAGCCCTGCCGGATCTGCGTCTGC
GACAACGGCAAGGTGTTGTGCGATGACGTGATCTGTGACGAGACCAAGAACTGCCCCGGCGCCGAAGTCCCCGAGGG
CGAGTGCTGTCCCGTCTGCCCCGACGGCTCAGAGTCACCCACCGACCAAGAAACCACCGGCGTCGAGGGACCCAAGG
GAGACACTGGCCCCCGAGGCCCAAGGGGACCCGCAGGCCCCCCTGGCCGAGATGGCATCCCTGGACAGCCTGGACTT
CCCGGACCCCCCGGACCCCCCGGACCTCCCGGACCCCCTGGCCTCGGAGGAAACTTTGCTCCCCAGCTGTCTTATGG
CTATGATGAGAAATCAACCGGAGGAATTTCCGTGCCTGGCCCCATGGGTCCCTCTGGTCCTCGTGGTCTCCCTGGCC
CCCCTGGTGCACCTGGTCCCCAAGGCTTCCAAGGTCCCCCTGGTGAGCCTGGCGAGCCTGGAGCTTCAGGTCCCATG
GGTCCCCGAGGTCCCCCAGGTCCCCCTGGAAAGAATGGAGATGATGGGGAAGCTGGAAAACCTGGTCGTCCTGGTGA
GCGTGGGCCTCCTGGGCCTCAGGGTGCTCGAGGATTGCCCGGAACAGCTGGCCTCCCTGGAATGAAGGGACACAGAG
GTTTCAGTGGTTTGGATGGTGCCAAGGGAGATGCTGGTCCTGCTGGTCCTAAGGGTGAGCCTGGCAGCCCTGGTGAA
AATGGAGCTCCTGGTCAGATGGGCCCCCGTGGCCTGCCTGGTGAGAGAGGTCGCCCTGGAGCCCCTGGCCCTGCTGG
TGCTCGTGGAAATGATGGTGCTACTGGTGCTGCCGGGCCCCCTGGTCCCACCGGCCCCGCTGGTCCTCCTGGCTTCC
CTGGTGCTGTTGGTGCTAAGGGTGAAGCTGGTCCCCAAGGGCCCCGAGGCTCTGAAGGTCCCCAGGGTGTGCGTGGT
GAGCCTGGCCCCCCTGGCCCTGCTGGTGCTGCTGGCCCTGCTGGAAACCCTGGTGCTGATGGACAGCCTGGTGCTAA
AGGTGCCAATGGTGCTCCTGGTATTGCTGGTGCTCCTGGCTTCCCTGGTGCCCGAGGCCCCTCTGGACCCCAGGGCC
CCGGCGGCCCTCCTGGTCCCAAGGGTAACAGCGGTGAACCTGGTGCTCCTGGCAGCAAAGGAGACACTGGTGCTAAG
GGAGAGCCTGGCCCTGTTGGTGTTCAAGGACCCCCTGGCCCTGCTGGAGAGGAAGGAAAGCGAGGAGCTCGAGGTGA
ACCCGGACCCACTGGCCTGCCCGGACCCCCTGGCGAGCGTGGTGGACCTGGTAGCCGTGGTTTCCCTGGCGCAGATG
GTGTTGCTGGTCCCAAGGGTCCCGCTGGTGAACGTGGTTCTCCTGGCCCCGCTGGCCCCAAAGGATCTCCTGGTGAA
GCTGGTCGTCCCGGTGAAGCTGGTCTGCCTGGTGCCAAGGGTCTGACTGGAAGCCCTGGCAGCCCTGGTCCTGATGG
CAAAACTGGCCCCCCTGGTCCCGCCGGTCAAGATGGTCGCCCCGGACCCCCAGGCCCACCTGGTGCCCGTGGTCAGG
CTGGTGTGATGGGATTCCCTGGACCTAAAGGTGCTGCTGGAGAGCCCGGCAAGGCTGGAGAGCGAGGTGTTCCCGGA
CCCCCTGGCGCTGTCGGTCCTGCTGGCAAAGATGGAGAGGCTGGAGCTCAGGGACCCCCTGGCCCTGCTGGTCCCGC
TGGCGAGAGAGGTGAACAAGGCCCTGCTGGCTCCCCCGGATTCCAGGGTCTCCCTGGTCCTGCTGGTCCTCCAGGTG
AAGCAGGCAAACCTGGTGAACAGGGTGTTCCTGGAGACCTTGGCGCCCCTGGCCCCTCTGGAGCAAGAGGCGAGAGA
GGTTTCCCTGGCGAGCGTGGTGTGCAAGGTCCCCCTGGTCCTGCTGGACCCCGAGGGGCCAACGGTGCTCCCGGCAA
CGATGGTGCTAAGGGTGATGCTGGTGCCCCTGGAGCTCCCGGTAGCCAGGGCGCCCCTGGCCTTCAGGGAATGCCTG
GTGAACGTGGTGCAGCTGGTCTTCCAGGGCCTAAGGGTGACAGAGGTGATGCTGGTCCCAAAGGTGCTGATGGCTCT
CCTGGCAAAGATGGCGTCCGTGGTCTGACCGGCCCCATTGGTCCTCCTGGCCCTGCTGGTGCCCCTGGTGACAAGGG
TGAAAGTGGTCCCAGCGGCCCTGCTGGTCCCACTGGAGCTCGTGGTGCCCCCGGAGACCGTGGTGAGCCTGGTCCCC
CCGGCCCTGCTGGCTTTGCTGGCCCCCCTGGTGCTGACGGCCAACCTGGTGCTAAAGGCGAACCTGGTGATGCTGGT
GCCAAAGGCGATGCTGGTCCCCCTGGGCCTGCCGGACCCGCTGGACCCCCTGGCCCCATTGGTAATGTTGGTGCTCC
TGGAGCCAAAGGTGCTCGCGGCAGCGCTGGTCCCCCTGGTGCTACTGGTTTCCCTGGTGCTGCTGGCCGAGTCGGTC
CTCCTGGCCCCTCTGGAAATGCTGGACCCCCTGGCCCTCCTGGTCCTGCTGGCAAAGAAGGCGGCAAAGGTCCCCGT
GGTGAGACTGGCCCTGCTGGACGTCCTGGTGAAGTTGGTCCCCCTGGTCCCCCTGGCCCTGCTGGCGAGAAAGGATC
CCCTGGTGCTGATGGTCCTGCTGGTGCTCCTGGTACTCCCGGGCCTCAAGGTATTGCTGGACAGCGTGGTGTGGTCG
GCCTGCCTGGTCAGAGAGGAGAGAGAGGCTTCCCTGGTCTTCCTGGCCCCTCTGGTGAACCTGGCAAACAAGGTCCC
TCTGGAGCAAGTGGTGAACGTGGTCCCCCCGGTCCCATGGGCCCCCCTGGATTGGCTGGACCCCCTGGTGAATCTGG
ACGTGAGGGGGCTCCTGCTGCCGAAGGTTCCCCTGGACGAGACGGTTCTCCTGGCGCCAAGGGTGACCGTGGTGAGA
CCGGCCCCGCTGGACCCCCTGGTGCTCCTGGTGCTCCTGGTGCCCCTGGCCCCGTTGGCCCTGCTGGCAAGAGTGGT
GATCGTGGTGAGACTGGTCCTGCTGGTCCCGCCGGTCCCGTCGGCCCCGTCGGCGCCCGTGGCCCCGCCGGACCCCA
AGGCCCCCGTGGTGACAAGGGTGAGACAGGCGAACAGGGCGACAGAGGCATAAAGGGTCACCGTGGCTTCTCTGGCC
TCCAGGGTCCCCCTGGCCCTCCTGGCTCTCCTGGTGAACAAGGTCCCTCTGGAGCCTCTGGTCCTGCTGGTCCCCGA
GGTCCCCCTGGCTCTGCTGGTGCTCCTGGCAAAGATGGACTCAACGGTCTCCCTGGCCCCATTGGCCCCCCTGGTCC
TCGCGGTCGCACTGGTGATGCTGGTCCTGTTGGTCCCCCCGGCCCTCCTGGACCTCCTGGTCCCCCTGGTCCTCCCA
GCGCTGGTTTCGACTTCAGCTTCCTGCCCCAGCCACCTCAAGAGAAGGCTCACGATGGTGGCCGCTACTACCGGGCT
GATGATGCCAATGTGGTTCGTGACCGTGACCTCGAGGTGGACACCACCCTCAAGAGCCTGAGCCAGCAGATCGAGAA
CATCCGGAGCCCAGAGGGAAGCCGCAAGAACCCCGCCCGCACCTGCCGTGACCTCAAGATGTGCCACTCTGACTGGA
AGAGTGGAGAGTACTGGATTGACCCCAACCAAGGCTGCAACCTGGATGCCATCAAAGTCTTCTGCAACATGGAGACT
GGTGAGACCTGCGTGTACCCCACTCAGCCCAGTGTGGCCCAGAAGAACTGGTACATCAGCAAGAACCCCAAGGACAA
GAGGCATGTCTGGTTCGGCGAGAGCATGACCGATGGATTCCAGTTCGAGTATGGCGGCCAGGGCTCCGACCCTGCCG
ATGTGGCCATCCAGCTGACCTTCCTGCGCCTGATGTCCACCGAGGCCTCCCAGAACATCACCTACCACTGCAAGAAC
AGCGTGGCCTACATGGACCAGCAGACTGGCAACCTCAAGAAGGCCCTGCTCCTCAAGGGCTCCAACGAGATCGAGAT
CCGCGCCGAGGGCAACAGCCGCTTCACCTACAGCGTCACTGTCGATGGCTGCACGAGTCACACCGGAGCCTGGGGCA
AGACAGTGATTGAATACAAAACCACCAAGTCCTCCCGCCTGCCCATCATCGATGTGGCCCCCTTGGACGTTGGTGCC
CCAGACCAGGAATTCGGCTTCGACGTTGGCCCTGTCTGCTTCCTGTAAACTCCCTCCATCCCAACCTGGCTCCCTCC
CACCCAACCAACTTTCCCCCCAACCCGGAAACAGACAAGCAACCCAAACTGAACCCCCCCAAAAGCCAAAAAATGGG
AGACAATTTCACATGGACTTTGGAAAATATTTTTTTCCTTTGCATTCATCTCTCAAACTTAGTTTTTATCTTTGACC
AACCGAACATGACCAAAAACCAAAAGTGCATTCAACCTTACCAAAAAAAAAAAAAAAAAAAAAAGAATAAATAAATA

FIGURE 63B

AGTTTTTAAAAAAGGAAGCTTGGTCCACTTGCTTGAAGACCCATGCGGGGGTAAGTCCCTTTCTGCCCGTTGGGTTA
TGAAACCCCAATGCTGCCCTTTCTGCTCCTTTCTCCACACCCCCCTTGGCCTCCCCTCCACTCCTTCCCAAATCTGT
CTCCCCAGAAGACACAGGAAACAATGTATTGTCTGCCCAGCAATCAAAGGCAATGCTCAAACACCCAAGTGGCCCCC
ACCCTCAGCCCGCTCCTGCCCGCCCAGCACCCCCAGGCCCTGGGGACCTGGGGTTCTCAGACTGCCAAAGAAGCCTT
GCCATCTGGCGCTCCCATGGCTCTTGCAACATCTCCCCTTCGTTTTTGAGGGGGTCATGCCGGGGGAGCCACCAGCC
CCTCACTGGGTTCGGAGGAGAGTCAGGAAGGGCCACGACAAAGCAGAAACATCGGATTTGGGGAACGCGTGTCATCC
CTTGTGCCGCAGGCTGGGCGGGAGAGACTGTTCTGTTCTGTTCCTTGTGTAACTGTGTTGCTGAAAGACTACCTCGT
TCTTGTCTTGATGTGTCACCGGGGCAACTGCCTGGGGGCGGGGATGGGGGCAGGGTGGAAGCGGCTCCCCATTTTTA
TACCAAAGGTGCTACATCTATGTGATGGGTGGGGTGGGGAGGGAATCACTGGTGCTATAGAAATTGAGATGCCCCCC
CAGGCCAGCAAATGTTCCTTTTTGTTCAAAGTCTATTTTTATTCCTTGATATTTTTTCTTTCTTTTTTTTTTTTTTT
GTGGATGGGGACTTGTGAATTTTTCTAAAGGTGCTATTTAACATGGGAGGAGAGCGTGTGCGCTCCAGCCCAGCCCG
CTGCTCACTTTCCACCCTCTCTCCACCTGCCTCTGGCTTCTCAGGCCTCTGCTCTCCGACCTCTCTCCTCTGAAACC
CTCCTCCACAGCTGCAGCCCATCCTCCCGGCTCCCTCCTAGTCTGTCCTGCGTCCTCTGTCCCCGGGTTTCAGAGAC
AACTTCCCAAAGCACAAAGCAGTTTTTCCCTAGGGGTGGGAGGAAGCAAAAGACTCTGTACCTATTTTGTATGTGTA
TAATAATTTGAGATGTTTTTAATTATTTTGATTGCTGGAATAAAGCATGTGGAAATGACCCAAACATAATCCGCAGT
GGCCTCCTAATTTCCTTCTTTGGAGTTGGGGGAGGGGTAGACATGGGGAAGGGGCCTTGGGGTGATGGGCTTGCCTT
CCATTCCTGCCCTTTCCCTCCCCACTATTCTCTTCTAGATCCCTCCATAACCCCACTCCCCTTTCTCTCACCCTTCT
TATACCGCAAACCTTTCTACTTCCTCTTTCATTTTCTATTCTTGCAATTTCCTTGCACCTTTTCCAAATCCTCTTCT
CCCCTGCAATACCATACAGGCAATCCACGTGCACAACACACACACACACTCTTCACATCTGGGGTTGTCCAAACCTC
ATACCCACTCCCCTTCAAGCCCATCCACTCTCCACCCCCTGGATGCCCTGCACTTGGTGGCGGTGGGATGCTCATGG
ATACTGGGAGGGTGAGGGGAGTGGAACCCGTGAGGAGGACCTGGGGGCCTCTCCTTGAACTGACATGAAGGGTCATC
TGGCCTCTGCTCCCTTCTCACCCACGCTGACCTCCTGCCGAAGGAGCAACGCAACAGGAGAGGGGTCTGCTGAGCCT
GGCGAGGGTCTGGGAGGGACCAGGAGGAAGGCGTGCTCCCTGCTCGCTGTCCTGGCCCTGGGGGAGTGAGGGAGACA
GACACCTGGGAGAGCTGTGGGAAGGCACTCGCACCGTGCTCTTGGGAAGGAAGGAGACCTGGCCCTGCTCACCACG
GACTGGGTGCCTCGACCTCCTGAATCCCCAGAACACAACCCCCCTGGGCTGGGGTGGTCTGGGAACCATCGTGCCC
CCGCCTCCCGCCTACTCCTTTTTAAGCTT

FIGURE 64A

GTGTCCCATAGTGTTTCCAAACTTGGAAAGGGCGGGGGAGGGCGGGAGGATGCGGAGGGCGGAGGTATGCAGACAAC
GAGTCAGAGTTTCCCCTTGAAAGCCTCAAAAGTGTCCACGTCCTCAAAAAGAATGGAACCAATTTAAGAAGCCAGCC
CCGTGGCCACGTCCCTTCCCCCATTCGGGCCCTCCTCTGCGCCCCCGCAGGCTCCTCCCAGCTGTGGCTGCCCGGGC
CCCCAGCCCCAGCCCTCCCATTGGTGGAGGCCCTTTTGGAGGCACCCTAGGGCCAGGGAAACTTTTGCCGTATAAAT
AGGGCAGATCCGGGATTTGTTATTTTAGCACCACGGCAGCAGGAGGTTTCGGCTAAGTTGGAGGTACTGGCCACGAC
TGCATGCCCGCGCCCGCCATGTGATACCTCCGCCGGTGACCCAGGGCTCTGCGACACAAGGAGTCGCATGTCTAAGT
GCTAGAC<u>ATG</u>CTCAGCTTTGTGGATACGCGGACTTTGTTGCTGCTTGCAGTAACCTTATGCCTAGCAACATGCCAAT
CTTTACAAGAGGAAACTGTAAGAAAGGGCCCAGCCGGAGATAGAGGACCACGTGGAGAAAGGGGTCCACCAGGCCCC
CCAGGCAGAGATGGTGAAGATGGTCCCACAGGCCCTCCTGGTCCACCTGGTCCTCCTGGCCCCCCTGGTCTCGGTGG
GAACTTTGCTGCTCAGTATGATGGAAAAGGAGTTGGACTTGGCCCTGGACCAATGGGCTTAATGGGACCTAGAGGCC
CACCTGGTGCAGCTGGAGCCCCAGGCCCTCAAGGTTTCCAAGGACCTGCTGGTGAGCCTGGTGAACCTGGTCAAACT
GGTCCTGCAGGTGCTCGTGGTCCAGCTGGCCCTCCTGGCAAGGCTGGTGAAGATGGTCACCCTGGAAAACCCGGACG
ACCTGGTGAGAGAGGAGTTGTTGGACCACAGGGTGCTCGTGGTTTCCCTGGAACTCCTGGACTTCCTGGCTTCAAAG
GCATTAGGGGACACAATGGTCTGGATGGATTGAAGGGACAGCCCGGTGCTCCTGGTGTGAAGGGTGAACCTGGTGCC
CCTGGTGAAAATGGAACTCCAGGTCAAACAGGAGCCCGTGGTCTTCCTGGTGAGAGAGGACGTGTTGGTGCCCCTGG
TCCAGCTGGTGCCCGTGGAAGTGATGGAAGTGTGGGTCCCGTAGGTCCTGCTGGTCCTAATGGGTCTGCTGGCCCTC
CAGGTTTCCCAGGTGCCCCTGGTCCCAAGGGTGAAATTGGAGCTGTTGGTAACGCTGGTCCTACTGGACCCGCCGGT
CCCCGTGGTGAAGTGGGTCTTCCAGGCCTCTCCGGCCCCGTTGGACCTCCTGGTAATCCTGGAGCAAACGGCCTTAC
TGGTGCCAAGGGTGCTGCTGGCCTTCCCGGCGTTGCTGGGGCTCCCGGCCTCCCTGGACCCCGCGGTATTCCTGGCC
CTCCTGGTGCTGCCGGTACTACTGGTGCCAGAGGACTTGTTGGTGAGCCTGGTCCAGCTGGCTCCAAAGGAGAGAGC
GGTAACAAGGGTGAGCCCGGCTCCGCTGGTCCCCAAGGTCCTCCTGGTCCCAGTGGTGAAGAAGGAAAGAGAGGCCC
TAATGGGGAAGCTGGATCTGCCGGCCCTCCAGGACCTCCTGGGCTGAGAGGTAGTCCTGGTTCTCGTGGTCTTCCTG
GAGCTGATGGCAGAGCTGGCGTCATGGGCCCTCCTGGTAGTCGTGGTGCAAGTGGCCCTGCTGGAGTCCGAGGACCT
AATGGAGATGCTGGTCGCCCTGGGGAGCCTGGTCTCATGGGACCCAGAGGTCTTCCTGGTTCCCCTGGAAATATCGG
CCCCGCTGGAAAAGAAGGTCCTGTCGGCCTCCCTGGCATCGACGGCAGGCCTGGCCCAATTGGCCCCGTTGGAGCAA
GAGGAGAGCCTGGCAACATTGGATTCCCTGGACCCAAAGGCCCCACTGGTGACCCTGGCAAAAACGGTGATAAAGGT
CATGCTGGTCTTGCTGGTGCTCGGGGTGCTCCAGGTCCTGATGGAAACAATGGTGCTCAGGGACCTCCTGGACCACA
GGGTGTTCAAGGTGGAAAAGGTGAACAGGGTCCCGCTGGTCCTCCAGGCTTCCAGGGTCTGCCTGGCCCCTCAGGTC
CCGCTGGTGAAGTTGGCAAACCAGGAGAAAGGGGTCTCCATGGTGAGTTTGGTCTCCCTGGTCCTGCTGGTCCAAGA
GGGGAACGCGGTCCCCCAGGTGAGAGTGGTGCTGCCGGTCCTACTGGTCCTATTGGAAGCCGAGGTCCTTCTGGACC
CCCAGGGCCTGATGGAAACAAGGGTGAACCTGGTGTGGTTGGTGCTGTGGGCACTGCTGGTCCATCTGGTCCTAGTG
GACTCCCAGGAGAGAGGGGTGCTGCTGGCATACCTGGAGGCAAGGGAGAAAAGGGTGAACCTGGTCTCAGAGGTGAA
ATTGGTAACCCTGGCAGAGATGGTGCTCGTGGTGCTCATGGTGCTGTAGGTGCCCCTGGTCCTGCTGGAGCCACAGG
TGACCGGGGCGAAGCTGGGGCTGCTGGTCCTGCTGGTCCTGCTGGTCCTCGGGGAAGCCCTGGTGAACGTGGCGAGG
TCGGTCCTGCTGGCCCCAACGGATTTGCTGGTCCGGCTGGTGCTGCTGGTCAACCGGGTGCTAAAGGAGAAAGAGGA
GGCAAAGGGCCTAAGGGTGAAAACGGTGTTGTTGGTCCCACAGGCCCCGTTGGAGCTGCTGGCCCAGCTGGTCCAAA
TGGTCCCCCCGGTCCTGCTGGAAGTCGTGGTGATGGAGGCCCCCCTGGTATGACTGGTTTCCCTGGTGCTGCTGGAC
GGACTGGTCCCCCAGGACCCTCTGGTATTTCTGGCCCTCCTGGTCCCCCTGGTCCTGCTGGGAAAGAAGGGCTTCGT
GGTCCTCGTGGTGACCAAGGTCCAGTTGGCCGAACTGGAGAAGTAGGTGCAGTTGGTCCCCCTGGCTTCGCTGGTGA
GAAGGGTCCCTCTGGAGAGGCTGGTACTGCTGGACCTCCTGGCACTCCAGGTCCTCAGGGTCTTCTTGGTGCTCCTG
GTATTCTGGGTCTCCCTGGCTCGAGAGGTGAACGTGGTCTACCTGGTGTTGCTGGTGCTGTGGGTGAACCTGGTCCT
CTTGGCATTGCCGGCCCTCCTGGGGCCCGTGGTCCTCCTGGTGCTGTGGGTAGTCCTGGAGTCAACGGTGCTCCTGG
TGAAGCTGGTCGTGATGGCAACCCTGGGAACGATGGTCCCCCAGGTCGCGATGGTCAACCCGGACACAAGGGAGAGC
GCGGTTACCCTGGCAATATTGGTCCCGTTGGTGCTGCAGGTGCACCTGGTCCTCATGGCCCCGTGGGTCCTGCTGGC
AAACATGGAAACCGTGGTGAAACTGGTCCTTCTGGTCCTGTTGGTCCTGCTGGTGCTGTTGGCCCAAGAGGTCCTAG
TGGCCCACAAGGCATTCGTGGCGATAAGGGAGAGCCCGGTGAAAAGGGGCCCAGAGGTCTTCCTGGCTTCAAGGGAC
ACAATGGATTGCAAGGTCTGCCTGGTATCGCTGGTCACCATGGTGATCAAGGTGCTCCTGGCTCCGTGGGTCCTGCT
GGTCCTAGGGGCCCTGCTGGTCCTTCTGGCCCTGCTGGAAAAGATGGTCGCACTGGACATCCTGGTACGGTTGGACC
TGCTGGCATTCGAGGCCCTCAGGGTCACCAAGGCCCTGCTGGCCCCCCTGGTCCCCCTGGCCCTCCTGGACCTCCAG
GTGTAAGCGGTGGTGGTTATGACTTTGGTTACGATGGAGACTTCTACAGGGCTGACCAGCCTCGCTCAGCACCTTCT
CTCAGACCCAAGGACTATGAAGTTGATGCTACTCTGAAGTCTCTCAACAACCAGATTGAGACCCTTCTTACTCCTGA
AGGCTCTAGAAAGAACCCAGCTCGCACATGCCGTGACTTGAGACTCAGCCACCCAGAGTGGAGCAGCGGTTACTACT
GGATTGACCCCAACCAAGGATGCACTATGGAAGCCATCAAAGTATACTGTGATTTCCCTACCGGCGAAACCTGTATC
CGGGCCCAACCTGAAAACATCCCAGCCAAGAACTGGTATAGGAGCTCCAAGGACAAGAAACACGTCTGGCTAGGAGA
AACTATCAATGCTGGCAGCCAGTTTGAATATAATGTTGAAGGAGTGACTTCCAAGGAAATGGCTACCCAACTTGCCT
TCATGCGCCTGCTGGCCAACTATGCCTCTCAGAACATCACCTACCACTGCAAGAACAGCATTGCATACATGGATGAG
GAGACTGGCAACCTGAAAAAGGCTGTCATTCTACAGGGCTCTAATGATGTTGAACTTGTTGCTGAGGGCAACAGCAG
GTTCACTTACACTGTTCTTGTAGATGGCTGCTCTAAAAAGACAAATGAATGGGGAAAGACAATCATTGAATACAAAA
CAAATAAGCCATCACGCCTGCCCTTCCTTGATATTGCACCTTTGGACATCGGTGGTGCTGACCATGAATTCTTTGTG
GACATTGGCCCAGTCTGTTTCAAA<u>TAA</u>ATGAACTCAATCTAAATTAAAAAAGAAAGAAATTTGAAAAAACTTTCTCT
TTGCCATTTCTTCTTCTTCTTTTTTAACTGAAAGCTGAATCCTTCCATTTCTTCTGCACATCTACTTGCTTAAATTG
TGGGCAAAAGAGAAAAAGAAGGATTGATCAGAGCATTGTGCAATACAGTTTCATTAACTCCTTCCCCCGCTCCCCCA

FIGURE 64B

AAAATTTGAATTTTTTTTTCAACACTCTTACACCTGTTATGGAAAATGTCAACCTTTGTAAGAAAACCAAAATAAAA
ATTGAAAAATAAAAACCATAAACATTTGCACCACTTGTGGCTTTTGAATATCTTCCACAGAGGGAAGTTTAAAACCC
AAACTTCCAAAGGTTTAAACTACCTCAAAACACTTTCCCATGAGTGTGATCCACATTGTTAGGTGCTGACCTAGACA
GAGATGAACTGAGGTCCTTGTTTTGTTTTGTTCATAATACAAAGGTGCTAATTAATAGTATTTCAGATACTTGAAGA
ATGTTGATGGTGCTAGAAGAATTTGAGAAGAAATACTCCTGTATTGAGTTGTATCGTGTGGTGTATTTTTTAAAAAA
TTTGATTTAGCATTCATATTTTCCATCTTATTCCCAATTAAAAGTATGCAGATTATTTGCCCAAAGTTGTCCTCTTC
TTCAGATTCAGCATTTGTTCTTTGCCAGTCTCATTTTCATCTTCTTCCATGGTTCCACAGAAGCTTTGTTTCTTGGG
CAAGCAGAAAAATTAAATTGTACCTATTTTGTATATGTGAGATGTTTAAATAAATTGTGAAAAAAATGAAATAAAGC
ATGTTTGGTTTTCCAAAAGAACATAT

FIGURE 65A

CGGGCCCGGTGCTGAAGGGCAGGGAACAACTTGATGGTGCTACTTTGAACTGCTTTTCTTTTCTCCTTTTTGCACAA
AGAGTCTCATGTCTGATATTTAGACATGATGAGCTTTGTGCAAAAGGGGAGCTGGCTACTTCTCGCTCTGCTTCATC
CCACTATTATTTTGGCACAACAGGAAGCTGTTGAAGGAGGATGTTCCCATCTTGGTCAGTCCTATGCGGATAGAGAT
GTCTGGAAGCCAGAACCATGCCAAATATGTGTCTGTGACTCAGGATCCGTTCTCTGCGATGACATAATATGTGACGA
TCAAGAATTAGACTGCCCCAACCCAGAAATTCCATTTGGAGAATGTTGTGCAGTTTGCCCACAGCCTCCAACTGCTC
CTACTCGCCCTCCTAATGGTCAAGGACCTCAAGGCCCCAAGGGAGATCCAGGCCCTCCTGGTATTCCTGGGAGAAAT
GGTGACCCTGGTATTCCAGGACAACCAGGGTCCCCTGGTTCTCCTGGCCCCCCTGGAATCTGTGAATCATGCCCTAC
TGGTCCTCAGAACTATTCTCCCCAGTATGATTCATATGATGTCAAGTCTGGAGTAGCAGTAGGAGGACTCGCAGGCT
ATCCTGGACCAGCTGGCCCCCCAGGCCCTCCCGGTCCCCCTGGTACATCTGGTCATCCTGGTTCCCCTGGATCTCCA
GGATACCAAGGACCCCCTGGTGAACCTGGGCAAGCTGGTCCTTCAGGCCCTCCAGGACCTCCTGGTGCTATAGGTCC
ATCTGGTCCTGCTGGAAAAGATGGAGAATCAGGTAGACCCGGACGACCTGGAGAGCGAGGATTGCCTGGACCTCCAG
GTATCAAAGGTCCAGCTGGGATACCTGGATTCCCTGGTATGAAAGGACACAGAGGCTTCGATGGACGAAATGGAGAA
AAGGGTGAAACAGGTGCTCCTGGATTAAAGGGTGAAAATGGTCTTCCAGGCGAAAATGGAGCTCCTGGACCCATGGG
TCCAAGAGGGGCTCCTGGTGAGCGAGGACGGCCAGGACTTCCTGGGGCTGCAGGTGCTCGGGGTAATGACGGTGCTC
GAGGCAGTGATGGTCAACCAGGCCCTCCTGGTCCTCCTGGAACTGCCGGATTCCCTGGATCCCCTGGTGCTAAGGGT
GAAGTTGGACCTGCAGGGTCTCCTGGTTCAAATGGTGCCCCTGGACAAAGAGGAGAACCTGGACCTCAGGGACACGC
TGGTGCTCAAGGTCCTCCTGGCCCTCCTGGGATTAATGGTAGTCCTGGTGGTAAAGGCGAAATGGGTCCCGCTGGCA
TTCCTGGAGCTCCTGGACTGATGGGAGCCCGGGGTCCTCCAGGACCAGCCGGTGCTAATGGTGCTCCTGGACTGCGA
GGTGGTGCAGGTGAGCCTGGTAAGAATGGTGCCAAAGGAGAGCCCGGACCACGTGGTGAACGCGGTGAGGCTGGTAT
TCCAGGTGTTCCAGGAGCTAAAGGCGAAGATGGCAAGGATGGATCACCTGGAGAACCTGGTGCAAATGGGCTTCCAG
GAGCTGCAGGAGAAAGGGGTGCCCCTGGGTTCCGAGGACCTGCTGGACCAAATGGCATCCCAGGAGAAAAGGGTCCT
GCTGGAGAGCGTGGTGCTCCAGGCCCTGCAGGGCCCAGAGGAGCTGCTGGAGAACCTGGCAGAGATGGCGTCCCTGG
AGGTCCAGGAATGAGGGGCATGCCCGGAAGTCCAGGAGGACCAGGAAGTGATGGGAAACCAGGGCCTCCCGGAAGTC
AAGGAGAAAGTGGTCGACCAGGTCCTCCTGGGCCATCTGGTCCCCGAGGTCAGCCTGGTGTCATGGGCTTCCCCGGT
CCTAAAGGAAATGATGGTGCTCCTGGTAAGAATGGAGAACGAGGTGGCCCTGGAGGACCTGGCCCTCAGGGTCCTCC
TGGAAAGAATGGTGAAACTGGACCTCAAGGACCCCCAGGGCCTACTGGGCCTGGTGGTGACAAAGGAGACACAGGAC
CCCCTGGTCCACAAGGATTACAAGGCTTGCCTGGTACAGGTGGTCCTCCAGGAGAAAATGGAAAACCTGGGGAACCA
GGTCCAAAGGGTGATGCCGGTGCACCTGGAGCTCCAGGAGGCAAGGGTGATGCTGGTGCCCCTGGTGAACGTGGACC
TCCTGGATTGGCAGGGGCCCCAGGACTTAGAGGTGGAGCTGGTCCCCCTGGTCCCGAAGGAGGAAAGGGTGCTGCTG
GTCCTCCTGGGCCACCTGGTGCTGCTGGTACTCCTGGTCTGCAAGGAATGCCTGGAGAAAGAGGAGGTCTTGGAAGT
CCTGGTCCAAAGGGTGACAAGGGTGAACCAGGCGGCCCAGGTGCTGATGGTGTCCCAGGGAAAGATGGCCCAAGGGG
TCCTACTGGTCCTATTGGTCCTCCTGGCCCAGCTGGCCAGCCTGGAGATAAGGGTGAAGGTGGTGCCCCCGGACTTC
CAGGTATAGCTGGACCTCGTGGTAGCCCTGGTGAGAGAGGTGAAACTGGCCCTCCAGGACCTGCTGGTTTCCCTGGT
GCTCCTGGACAGAATGGTGAACCTGGTGGTAAAGGAGAAAGAGGGGCTCCGGGTGAGAAAGGTGAAGGAGGCCCTCC
TGGAGTTGCAGGACCCCCTGGAGGTTCTGGACCTGCTGGTCCTCCTGGTCCCCAAGGTGTCAAAGGTGAACGTGGCA
GTCCTGGTGGACCTGGTGCTGCTGGCTTCCCTGGTGCTCGTGGTCTTCCTGGTCCTCCTGGTAGTAATGGTAACCCA
GGACCCCCAGGTCCCAGCGGTTCTCCAGGCAAGGATGGGCCCCCAGGTCCTGCGGGTAACACTGGTGCTCCTGGCAG
CCCTGGAGTGTCTGGACCAAAAGGTGATGCTGGCCAACCAGGAGAGAAGGGATCGCCTGGTGCCCAGGGCCCACCAG
GAGCTCCAGGCCCACTTGGGATTGCTGGGATCACTGGAGCACGGGGTCTTGCAGGACCACCAGGCATGCCAGGTCCT
AGGGGAAGCCCTGGCCCTCAGGGTGTCAAGGGTGAAAGTGGGAAACCAGGAGCTAACGGTCTCAGTGGAGAACGTGG
TCCCCCTGGACCCCAGGGTCTTCCTGGTCTGGCTGGTACAGCTGGTGAACCTGGAAGAGATGGAAACCCTGGATCAG
ATGGTCTTCCAGGCCGAGATGGATCTCCTGGTGGCAAGGGTGATCGTGGTGAAAATGGCTCTCCTGGTGCCCCTGGC
GCTCCTGGTCATCCAGGCCCACCTGGTCCTGTCGGTCCAGCTGGAAAGAGTGGTGACAGAGGAGAAAGTGGCCCTGC
TGGCCCTGCTGGTGCTCCCGGTCCTGCTGGTTCCCGAGGTGCTCCTGGTCCTCAAGGCCCACGTGGTGACAAAGGTG
AAACAGGTGAACGTGGAGCTGCTGGCATCAAAGGACATCGAGGATTCCCTGGTAATCCAGGTGCCCCAGGTTCTCCA
GGCCCTGCTGGTCAGCAGGGTGCAATCGGCAGTCCAGGACCTGCAGGCCCCAGAGGACCTGTTGGACCCAGTGGACC
TCCTGGCAAAGATGGAACCAGTGGACATCCAGGTCCCATTGGACCACCAGGGCCTCGAGGTAACAGAGGTGAAAGAG
GATCTGAGGGCTCCCCAGGCCACCCAGGGCAACCAGGCCCTCCTGGACCTCCTGGTGCCCCTGGTCCTTGCTGTGGT
GGTGTTGGAGCCGCTGCCATTGCTGGGATTGGAGGTGAAAAAGCTGGCGGTTTTGCCCCGTATTATGGAGATGAACC
AATGGATTTCAAAATCAACACCGATGAGATTATGACTTCACTCAAGTCTGTTAATGGACAAATAGAAAGCCTCATTA
GTCCTGATGGTTCTCGTAAAAACCCCGCTAGAAACTGCAGAGACCTGAAATTCTGCCATCCTGAACTCAAGAGTGGA
GAATACTGGGTTGACCCTAACCAAGGATGCAAATTGGATGCTATCAAGGTATTCTGTAATATGGAAACTGGGGAAAC
ATGCATAAGTGCCAATCCTTTGAATGTTCCACGGAAACACTGGTGGACAGATTCTAGTGCTGAGAAGAAACACGTTT
GGTTTGGAGAGTCCATGGATGGTGGTTTTCAGTTTAGCTACGGCAATCCTGAACTTCCTGAAGATGTCCTTGATGTG
CAGCTGGCATTCCTTCGACTTCTCTCCAGCCGAGCTTCCCAGAACATCACATATCACTGCAAAAATAGCATTGCATA
CATGGATCAGGCCAGTGGAAATGTAAAGAAGGCCCTGAAGCTGATGGGGTCAAATGAAGGTGAATTCAAGGCTGAAG
GAAATAGCAAATTCACCTACACAGTTCTGGAGGATGGTTGCACGAAACACACTGGGGAATGGAGCAAAACAGTCTTT
GAATATCGAACACGCAAGGCTGTGAGACTACCTATTGTAGATATTGCACCCTATGACATTGGTGGTCCTGATCAAGA
ATTTGGTGTGGACGTTGGCCCTGTTTGCTTTTTATAAACCAAACTCTATCTGAAATCCCAACAAAAAAAAATTTAACT
CCATATGTGTTCCTCTTGTTCTAATCTTGTCAACCAGTGCAAGTGACCGACAAAATTCCAGTTATTTATTTCCAAAA
TGTTTGGAAACAGTATAATTTGACAAAGAAAAATGATACTTCTCTTTTTTTGCTGTTCCACCAAATACAATTCAAAT
GCTTTTTGTTTTATTTTTTTACCAATTCCAATTTCAAAATGTCTCAATGGTGCTATAATAAATAAACTTCAACACTC

FIGURE 65B

TTTATGATAACAACACTGTGTTATATTCTTTGAATCCTAGCCCATCTGCAGAGCAATGACTGTGCTCACCAGTAAAA
GATAACCTTTCTTTCTGAAATAGTCAAATACGAAATTAGAAAAGCCCTCCCTATTTTAACTACCTCAACTGGTCAGA
AACACAGATTGTATTCTATGAGTCCCAGAAGATGAAAAAAATTTTATACGTTGATAAAACTTATAAATTTCATTGAT
TAATCTCCTGGAAGATTGGTTTAAAAAGAAAAGTGTAATGCAAGAATTTAAAGAAATATTTTTAAAGCCACAATTAT
TTTAATATTGGATATCAACTGCTTGTAAAGGTGCTCCTCTTTTTTCTTGTCATTGCTGGTCAAGATTACTAATATTT
GGGAAGGCTTTAAAGACGCATGTTATGGTGCTAATGTACTTTCACTTTTAAACTCTAGATCAGAATTGTTGACTTGC
ATTCAGAACATAAATGCACAAAATCTGTACATGTCTCCCATCAGAAAGATTCATTGGCATGCCACAGGGATTCTCCT
CCTTCATCCTGTAAAGGTCAACAATAAAAACCAAATTATGGGGCTGCTTTTGTCACACTAGCATAGAGAATGTGTTG
AAATTTAACTTTGTAAGCTTGTATGTGGTTGTTGATCTTTTTTTTCCTTACAGACACCCATAATAAAATA

FIGURE 66A

CAGTTTGGAGCTCAGTCTTCCACCAAAGGCCGTTCAGTTCTCCTGGGCTCCAGCCTCCTGCAAGGACTGCAAGAGTT
TTCCTCCGCAGCTCTGAGTCTCCACTTTTTTGGTGGAGAAAGGCTGCAAAAAGAAAAAGAGACGCAGTGAGTGGGAA
AAGTATGCATCCTATTCAAACCTAATTGAATCGAGGAGCCCAGGGACACACGCCTTCAGGTTTGCTCAGGGGTTCAT
ATTTGGTGCTTAGACAAATTCAAAATGAGGAAACATCGGCACTTGCCCTTAGTGGCCGTCTTTTGCCTCTTTCTCTC
AGGCTTTCCTACAACTCATGCCCAGCAGCAGCAAGCAGATGTCAAAAATGGTGCGGCTGCTGATATAATATTTCTAG
TGGATTCCTCTTGGACCATTGGAGAGGAACATTTCCAACTTGTTCGAGAGTTTCTATATGATGTTGTAAAATCCTTA
GCTGTGGGAGAAAATGATTTCCATTTTGCTCTGGTCCAGTTCAACGGAAACCCACATACCGAGTTCCTGTTAAATAC
GTATCGTACTAAACAAGAAGTCCTTTCTCATATTTCCAACATGTCTTATATTGGGGGAACCAATCAGACTGGAAAAG
GATTAGAATACATAATGCAAAGCCACCTCACCAAGGCTGCTGGAAGCCGGGCCGGTGACGGAGTCCCTCAGGTTATC
GTAGTGTTAACTGATGGACACTCGAAGGATGGCCTTGCTCTGCCCTCAGCGGAACTTAAGTCTGCTGATGTTAACGT
GTTTGCAATTGGAGTTGAGGATGCAGATGAAGGAGCGTTAAAAGAAATAGCAAGTGAACCGCTCAATATGCATATGT
TCAACCTAGAGAATTTTACCTCACTTCATGACATAGTAGGAAACTTAGTGTCCTGTGTGCATTCATCCGTGAGTCCA
GAAAGGGCTGGGGACACGGAAACCCTTAAAGACATCACAGCACAAGACTCTGCTGACATTATTTTCCTTATTGATGG
ATCAAACAACACCGGAAGTGTCAATTTCGCAGTCATTCTCGACTTCCTTGTAAATCTCCTTGAGAAACTCCCAATTG
GAACTCAGCAGATCCGAGTGGGGGTGGTCCAGTTTAGCGATGAGCCCAGAACCATGTTTTCCTTGGACACCTACTCC
ACCAAGGCCCAGGTTCTGGGTGCAGTGAAAGCCCTCGGGTTTGCTGGTGGGGAGTTGGCCAATATCGGCCTCGCCCT
TGATTTCGTGGTGGAGAACCACTTCACCCGGGCAGGGGGCAGCCGCGTGGAGGAAGGGGTTCCCCAGGTGCTGGTCC
TCATAAGTGCCGGGCCTTCTAGTGACGAGATTCGCTACGGGGTGGTAGCACTGAAGCAGGCTAGCGTGTTCTCATTC
GGCCTTGGAGCCCAGGCCGCCTCCAGGGCAGAGCTTCAGCACATAGCTACCGATGACAACTTGGTGTTTACTGTCCC
GGAATTCCGTAGCTTTGGGGACCTCCAGGAGAAATTACTGCCGTACATTGTTGGCGTGGCCCAAAGGCACATTGTCT
TGAAACCGCCAACCATTGTCACACAAGTCATTGAAGTCAACAAGAGAGACATAGTCTTCCTGGTGGATGGCTCATCT
GCACTGGGACTGGCCAACTTCAATGCCATCCGAGACTTCATTGCTAAAGTCATCCAGAGGCTGGAAATCGGACAGGA
TCTTATCCAGGTGGCAGTGGCCCAGTATGCAGACACTGTGAGGCCTGAATTTTATTTCAATACCCATCCAACAAAAA
GGGAAGTCATAACCGCTGTGCGGAAAATGAAGCCCCTGGACGGCTCGGCCCTGTACACGGGCTCTGCTCTAGACTTT
GTTCGTAACAACCTATTCACGAGTTCAGCCGGCTACCGGGCTGCCGAGGGGATTCCTAAGCTTTTGGTGCTGATCAC
AGGTGGTAAGTCCCTAGATGAAATCAGCCAGCCTGCCCAGGAGCTGAAGAGAAGCAGCATAATGGCCTTTGCCATTG
GGAACAAGGGTGCCGATCAGGCTGAGCTGGAAGAGATCGCTTTCGACTCCTCCCTGGTGTTCATCCCAGCTGAGTTC
CGAGCCGCCCCATTGCAAGGCATGCTGCCTGGCTTGCTGGCACCTCTCAGGACCCTCTCTGGAACCCCTGAAGTTCA
CTCAAACAAAAGAGATATCATCTTTCTTTTGGATGGATCAGCCAACGTTGGAAAAACCAATTTCCCTTATGTGCGCG
ACTTTGTAATGAACCTAGTTAACAGCCTTGATATTGGAAATGACAATATTCGTGTTGGTTTAGTGCAATTTAGTGAC
ACTCCTGTAACGGAGTTCTCTTTAAACACATACCAGACCAAGTCAGATATCCTTGGTCATCTGAGGCAGCTGCAGCT
CCAGGGAGGTTCGGGCCTGAACACAGGCTCAGCCCTAAGCTATGTCTATGCCAACCACTTCACGGAAGCTGGCGGCA
GCAGGATCCGTGAACACGTGCCGCAGCTCCTGCTTCTGCTCACAGCTGGGCAGTCTGAGGACTCCTATTTGCAAGCT
GCCAACGCCTTGACACGCGCGGGCATCCTGACTTTTTGTGTGGGAGCTAGCCAGGCGAATAAGGCAGAGCTTGAGCA
GATTGCTTTTAACCCAAGCCTGGTGTATCTCATGGATGATTTCAGCTCCCTGCCAGCTTTGCCTCAGCAGCTGATTC
AGCCCCTAACCACATATGTTAGTGGAGGTGTGGAGGAAGTACCACTCGCTCAGCCAGAGAGCAAGCGAGACATTCTG
TTCCTCTTTGACGGCTCAGCCAATCTTGTGGGCCAGTTCCCTGTTGTCCGTGACTTTCTCTACAAGATTATCGATGA
GCTCAATGTGAAGCCAGAGGGGACCCGAATTGCGGTGGCTCAGTACAGCGATGATGTCAAGGTGGAGTCCCGTTTTG
ATGAGCACCAGAGTAAGCCTGAGATCCTGAATCTTGTGAAGAGAATGAAGATCAAGACGGGCAAAGCCCTCAACCTG
GGCTACGCGCTGGACTATGCACAGAGGTACATTTTTGTGAAGTCTGCTGGCAGCCGGATCGAGGATGGAGTGCTTCA
GTTCCTGGTGCTGCTGGTCGCAGGAAGGTCATCTGACCGTGTGGATGGCCAGCAAGTAACCTGAAGCAGAGTGGGG
TTGTGCCTTTCATCTTCCAAGCCAAGAACGCAGACCCTGCTGAGTTAGAGCAGATCGTGCTGTCTCCAGCGTTTATC
CTGGCTGCAGAGTCGCTTCCCAAGATTGGAGATCTTCATCCACAGATAGTGAATCTCTTAAAATCAGTGCACAACGG
AGCACCAGCACCAGTTTCAGGTGAAAAGGACGTGGTGTTTCTGCTTGATGGCTCTGAGGGCGTCAGGAGCGGCTTCC
CTCTGTTGAAAGAGTTTGTCCAGAGAGTGGTGGAAAGCCTGGATGTGGGCCAGGACCGGGTCCGCGTGGCCGTGGTG
CAGTACAGCGACCGGACCAGGCCCGAGTTCTACCTGAATTCATACATGAACAAGCAGGACGTCGTCAACGCTGTCCG
CCAGCTGACCCTGCTGGGAGGGCCGACCCCCAACACCGGGGCCGCCCTGGAGTTTGTCCTGAGGAACATCCTGGTCA
GCTCTGCGGGAAGCAGGATAACAGAAGGTGTGCCCCAGCTGCTGATCGTCCTCACGGCCGACAGGTCTGGGGATGAT
GTGCGGAACCCCTCCGTGGTCGTGAAGAGGGGTGGGGCTGTGCCCATTGGCATTGGCATCGGGAACGCTGACATCAC
AGAGATGCAGACCATCTCCTTCATCCCGGACTTTGCCGTGGCCATTCCCACCTTTCGCCAGCTGGGGACCGTCCAAC
AGGTCATCTCTGAGAGGGTGACCCAGCTCACCCGCGAGGAGCTGAGCAGGCTGCAGCCGGTGTTGCAGCCTCTACCG
AGCCCAGGTGTTGGTGGCAAGAGGGACGTGGTCTTTCTCATCGATGGGTCCCAAAGTGCCGGGCCTGAGTTCCAGTA
CGTTCGCACCCTCATAGAGAGGCTGGTTGACTACCTGGACGTGGGCTTTGACACCACCCGGGTGGCTGTCATCCAGT
TCAGCGATGACCCCAAGGCGGAGTTCCTGCTGAACGCCCATTCCAGCAAGGATGAAGTGCAGAACGCGGTGCAGCGG
CTGAGGCCCAAGGGAGGGCGGCAGATCAACGTGGGCAATGCCCTGGAGTACGTGTCCAGGAACATCTTCAAGAGGCC
CCTGGGGAGCCGCATTGAAGAGGGCGTCCCACAGTTCCTGGTCCTCATCTCGTCTGGAAAGTCTGACGATGAGGTGG
TCGTCCCGGCGGTGGAGCTCAAGCAGTTTGGCGTGGCCCCTTTCACGATCGCCAGGAACGCAGACCAGGAGGAGCTG
GTGAAGATCTCGCTGAGCCCCGAATATGTGTTCTCGGTGAGCACCTTCCGGGAGCTGCCCAGCCTGGAGCAGAAACT
GCTGACGCCCATCACGACCCTGACCTCAGAGCAGATCCAGAAGCTCTTAGCCAGCACTCGCTATCCACCTCCAGCAG
TTGAGAGTGATGCTGCAGACATTGTCTTTCTGATCGACAGCTCTGAGGGAGTTAGGCCAGATGGCTTTGCACATATT
CGAGATTTTGTTAGCAGGATTGTTCGAAGACTCAACATCGGCCCCAGTAAAGTGAGAGTTGGGGTCGTGCAGTTCAG
CAATGATGTCTTCCCAGAATTCTATCTGAAAACCTACAGATCCCAGGCCCCGGTGCTGGACGCCATACGGCGCCTGA

FIGURE 66B

GGCTCAGAGGGGGGTCCCCACTGAACACTGGCAAGGCTCTCGAATTTGTGGCAAGAAACCTCTTTGTTAAGTCTGCG
GGGAGTCGCATAGAAGACGGGGTGCCCCAACACCTGGTCCTGGTCCTGGGTGGAAAATCCCAGGACGATGTGTCCAG
GTTCGCCCAGGTGATCCGTTCCTCGGGCATTGTGAGTTTAGGGGTAGGAGACCGGAACATCGACAGAACAGAGCTGC
AGACCATCACCAATGACCCCAGACTGGTCTTCACAGTGCGAGAGTTCAGAGAGCTTCCCAACATAGAAGAAAGAATC
ATGAACTCGTTTGGACCCTCCGCAGCCACTCCTGCACCTCCAGGGGTGGACACCCCTCCTCCTTCACGGCCAGAGAA
GAAGAAAGCAGACATTGTGTTCCTGTTGGATGGTTCCATCAACTTCAGGAGGGACAGTTTCCAGGAAGTGCTTCGTT
TTGTGTCTGAAATAGTGGACACAGTTTATGAAGATGGCGACTCCATCCAAGTGGGGCTTGTCCAGTACAACTCTGAC
CCCACTGACGAATTCTTCCTGAAGGACTTCTCTACCAAGAGGCAGATTATTGACGCCATCAACAAAGTGGTCTACAA
AGGGGGAAGACACGCCAACACTAAGGTGGGCCTTGAGCACCTGCGGGTAAACCACTTTGTGCCTGAGGCAGGCAGCC
GCCTGGACCAGCGGGTCCCTCAGATTGCCTTTGTGATCACGGGAGGAAAGTCGGTGGAAGATGCACAGGATGTGAGC
CTGGCCCTCACCCAGAGGGGGGTCAAAGTGTTTGCTGTTGGAGTGAGGAATATCGACTCGGAGGAGGTTGGAAAGAT
AGCGTCCAACAGCGCCACAGCGTTCCGCGTGGGCAACGTCCAGGAGCTGTCCGAACTGAGCGAGCAAGTTTTGGAAA
CTTTGCATGATGCGATGCATGAAACCCTTTGCCCTGGTGTAACTGATGCTGCCAAAGCTTGTAATCTGGATGTGATT
CTGGGGTTTGATGGTTCTAGAGACCAGAATGTTTTTGTGGCCCAGAAGGGCTTCGAGTCCAAGGTGGACGCCATCTT
GAACAGAATCAGCCAGATGCACAGGGTCAGCTGCAGCGGTGGCCGCTCGCCCACCGTGCGTGTGTCAGTGGTGGCCA
ACACGCCCTCGGGCCCGGTGGAGGCCTTTGACTTTGACGAGTACCAGCCAGAGATGCTCGAGAAGTTCCGGAACATG
CGCAGCCAGCACCCCTACGTCCTCACGGAGGACACCCTGAAGGTCTACCTGAACAAGTTCAGACAGTCCTCGCCGGA
CAGCGTGAAGGTGGTCATTCATTTTACTGATGGAGCAGACGGAGATCTGGCTGATTTACACAGAGCATCTGAGAACC
TCCGCCAAGAAGGAGTCCGTGCCTTGATCCTGGTGGGCCTTGAACGAGTGGTCAACTTGGAGCGGCTAATGCATCTG
GAGTTTGGGCGAGGGTTTATGTATGACAGGCCCCTGAGGCTTAACTTGCTGGACTTGGATTATGAACTAGCGGAGCA
GCTTGACAACATTGCCGAGAAAGCTTGCTGTGGGGTTCCCTGCAAGTGCTCTGGGCAGAGGGGAGACCGCGGGCCCA
TCGGCAGCATCGGGCCAAAGGGTATTCCTGGAGAAGACGGCTACCGAGGCTATCCTGGTGATGAGGGTGGACCCGGT
GAGCGTGGTCCGCCTGGTGTGAACGGCACTCAAGGTTTCCAGGGCTGCCCGGGCCAGAGAGGAGTAAAGGGCTCTCG
GGGATTCCCAGGAGAGAAGGGCGAAGTAGGAGAAATTGGACTGGATGGTCTGGATGGTGAAGATGGAGACAAAGGAT
TGCCTGGTTCTTCTGGAGAGAAAGGGAATCCTGGAAGAAGGGGTGATAAAGGACCTCGAGGAGAGAAAGGAGAAAGA
GGAGATGTTGGGATTCGAGGGGACCCGGGTAACCCAGGACAAGACAGCCAGGAGAGAGGACCCAAAGGAGAAACCGG
TGACCTCGGCCCCATGGGTGTCCCAGGGAGAGATGGAGTACCTGGAGGACCTGGAGAAACTGGGAAGAATGGTGGCT
TTGGCCGAAGGGGACCCCCCGGAGCTAAGGGCAACAAGGGCGGTCCTGGCCAGCCGGGCTTTGAGGGAGAGCAGGGG
ACCAGAGGTGCACAGGGCCCAGCTGGTCCTGCTGGTCCTCCAGGGCTGATAGGAGAACAAGGCATTTCTGGACCTAG
GGGAAGCGGAGGTGCCCGTGGCGCTCCTGGAGAACGAGGCAGAACCGGTCCACTGGGAAGAAAGGGTGAGCCCGGAG
AGCCAGGACCAAAAGGAGGAATCGGGAACCCGGGCCCTCGTGGGGAGACGGGAGATGACGGGAGAGACGGAGTTGGC
AGTGAAGGACGCAGAGGCAAAAAAGGAGAAAGAGGATTTCCTGGATACCCAGGACCAAAGGGTAACCCAGGTGAACC
TGGGCTAAATGGAACAACAGGACCCAAAGGCATCAGAGGCCGAAGGGGAAATTCGGGACCTCCAGGGATAGTTGGAC
AGAAGGGGAGACCTGGCTACCCAGGACCAGCTGGTCCAAGGGGCAACAGGGGCGACTCCATCGATCAATGTGCCCTC
ATCCAAAGCATCAAAGATAAATGCCCTTGCTGTTACGGGCCCCTGGAGTGCCCCGTCTTCCCAACAGAACTAGCCTT
TGCTTTAGACACCTCTGAGGGAGTCAACCAAGACACTTTCGGCCGGATGCGAGATGTGGTCTTGAGTATTGTGAATG
TCCTGACCATTGCTGAGAGCAACTGCCCGACGGGGGCCCGGGTGGCTGTGGTCACCTACAACAACGAGGTGACCACG
GAGATCCGGTTTGCTGACTCCAAGAGGAAGTCGGTCCTCCTGGACAAGATTAAGAACCTTCAGGTGGCTCTGACATC
CAAACAGCAGAGTCTGGAGACTGCCATGTCGTTTGTGGCCAGGAACACATTTAAGCGTGTGAGGAACGGATTCCTAA
TGAGGAAAGTGGCTGTTTTCTTCAGCAACACACCCACAAGAGCATCCCCACAGCTCAGAGAGGCTGTGCTCAAACTC
TCAGATGCGGGGATCACCCCCTTGTTCCTTACAAGGCAGGAAGACCGGCAGCTCATCAACGCTTTGCAGATCAATAA
CACAGCAGTGGGGCATGCGCTTGTCCTGCCTGCAGGGAGAGACCTCACAGACTTCCTGGAGAATGTCCTCACGTGTC
ATGTTTGCTTGGACATCTGCAACATCGACCCATCCTGTGGATTTGGCAGTTGGAGGCCTTCCTTCAGGGACAGGAGA
GCGGCAGGGAGTGATGTGGACATCGACATGGCTTTCATCTTAGACAGCGCTGAGACCACCACCCTGTTCCAGTTCAA
TGAGATGAAGAAGTACATAGCGTACCTGGTCAGACAACTGGACATGAGCCCAGATCCCAAGGCCTCCCAGCACTTCG
CCAGAGTGGCAGTTGTGCAGCACGCGCCCTCTGAGTCCGTGGACAATGCCAGCATGCCACCTGTGAAGGTGGAATTC
TCCCTGACTGACTATGGCTCCAAGGAGAAGCTGGTGGACTTCCTCAGCAGGGGAATGACACAGTTGCAGGGAACCAG
GGCCTTAGGCAGTGCCATTGAATACACCATAGAGAATGTCTTTGAAAGTGCCCCAAACCCACGGGACCTGAAAATTG
TGGTCCTGATGCTGACGGGCGAGGTGCCGGAGCAGCAGCTGGAGGAGGCCCAGAGAGTCATCCTGCAGGCCAAATGC
AAGGGCTACTTCTTCGTGGTCCTGGGCATTGGCAGGAAGGTGAACATCAAGGAGGTATACACCTTCGCCAGTGAGCC
AAACGACGTCTTCTTCAAATTAGTGGACAAGTCCACCGAGCTCAACGAGGAGCCTTTGATGCGCTTCGGGAGGCTGT
TGCCGTCCTTCGTCAGCAGTGAAAATGCTTTTTACTTGTCCCCAGATATCAGGAAACAGTGTGATTGGTTCCAAGGG
GACCAACCCACAAAGAACCTTGTGAAGTTTGGTCACAAACAAGTAAATGTTCCGAATAACGTTACTTCAAGTCCTAC
ATCCAACCCAGTGACGACAACGAAGCCGGTGACTACGACGAAGCCGGTGACCACCACAAAGCCTGTAACCACCA
CAACAAAGCCTGTGACTATTATAAATCAGCCATCTGTGAAGCCAGCCGCTGCAAAGCCGGCCCCTGCGAAACCTGTG
GCTGCCAAGCCTGTGGCCACAAAGACGGCCACTGTTAGACCCCCAGTGGCGGTGAAGCCAGCAACAGCAGCGAAGCC
TGTAGCAGCAAAGCCAGCAGCTGTAAGACCCCCCGCTGCTGCTGCAAAACCAGTGGCGACCAAGCCTGAGGTCCCTA
GGCCACAGGCAGCCAAACCAGCTGCCACCAAGCCAGCCACCACTAAGCCCGTGGTTAAGATGCTCCGTGAAGTCCAG
GTGTTTGAGATAACAGAGAACAGCGCCAAACTCCACTGGGAGAGGCCTGAGCCCCCCGGTCCTTATTTTTATGACCT
CACCGTCACCTCAGCCCATGATCAGTCCCTGGTTCTGAAGCAGAACCTCACGGTCACGGACCGCGTCATTGGAGGCC
TGCTCGCTGGGCAGACATACCATGTGGCTGTGGTCTGCTACCTGAGGTCTCAGGTCAGAGCCACCTACCACGGAAGT
TTCAGTACAAAGAAATCTCAGCCCCCACCTCCACAGCCAGCAAGGTCAGCTTCTAGTTCAACCATCAATCTAATGGT
GAGCACAGAACCATTGGCTCTCACTGAAACAGATATATGCAAGTTGCCGAAAGACGAAGGAACTTGCAGGGATTTCA

FIGURE 66C

TATTAAAATGGTACTATGATCCAAACACCAAAAGCTGTGCAAGATTCTGGTATGGAGGTTGTGGTGGAAACGAAAAC
AAATTTGGATCACAGAAAGAATGTGAAAAGGTTTGCGCTCCTGTGCTCGCCAAACCCGGAGTCATCAGTGTGATGGG
AACCTAAGCGTGGGTGGCCAACATCATATACCTCTTGAAGAAGAAGGAGTCAGCCATCGCCAACTTGTCTCTGTAGA
AGCTCCGGGTGTAGATTCCCTTGCACTGTATCATTTCATGCTTTGATTTACACTCGAACTCGGGAGGGAACATCCTG
CTGCATGACCTATCAGTATGGTGCTAATGTGTCTGTGGACCCTCGCTCTCTGTCTCCAGCAGTTCTCTCGAATACTT
TGAATGTTGTGTAACAGTTAGCCACTGCTGGTGTTTATGTGAACATTCCTATCAATCCAAATTCCCTCTGGAGTTTC
ATGTTATGCCTGTTGCAGGCAAATGTAAAGTCTAGAAAATAATGCAAATGTCACGGCTACTCTATATACTTTTGCTT
GGTTCATTTTTTTTCCCTTTTAGTTAAGCATGACTTTAGATGGGAAGCCTGTGTATCGTGGAGAAACAAGAGACCAA
CTTTTTCATTCCCTGCCCCCAATTTCCCAGACTAGATTTCAAGCTAATTTTCTTTTTCTGAAGCCTCTAACAAATGA
TCTAGTTCAGAAGGAAGCAAAATCCCTTAATCTATGTGCACCGTTGGGACCAATGCCTTAATTAAAGAATTTAAAAA
AGTTGTAATAGAGAATATTTTTGGCATTCCTCTCAATGTTGTGTGTTTTTTTTTTTTGTGTGCTGGAGGGAGGGGAT
TTAATTTTAATTTTAAAATGTTTAGGAAATTTATACAAAGAAACTTTTTAATAAAGTATATTGAAAGTTTAAAAAAA
AAAAAAAAA

FIGURE 67

CTCTGTTTTCTCAAAGCTGAAGTCGGCTAGGTTTGCAAAGCTGTGGGCTGAGCACTCAGGCAATCACACTCTCAGAA
ACTGCGGCGGCTCTGGACTGCAGCCTCCCAAGGCTCCATGCCAGACAAAGCATGCGTGTCACACTTGCTACAATAGC
CTGGATGGTTTCTTTTGTCTCCAATTATTCACACACAGCAAATATTTTGCCAGATATCGAAAATGAAGATTTCATCA
AAGACTGCGTTCGAATCCATAACAAGTTCCGATCAGAGGTGAAACCAACAGCCAGTGATATGCTATACATGACTTGG
GACCCAGCACTAGCCCAAATTGCAAAAGCATGGGCCAGCAATTGCCAGTTTTCACATAATACACGGCTGAAGCCACC
CCACAAGCTGCACCCAAACTTCACTTCACTGGGAGAGAACATCTGGACTGGGTCTGTGCCCATTTTTTCTGTGTCTT
CCGCCATCACAAACTGGTATGACGAAATCCAGGACTATGACTTCAAGACTCGGATATGCAAAAAAGTCTGTGGCCAC
TACACTCAGGTTGTTTGGGCAGATAGTTACAAAGTTGGCTGCGCAGTTCAATTTTGCCCTAAAGTTTCTGGCTTTGA
CGCTCTTTCCAATGGAGCACATTTTATATGCAACTACGGACCAGGAGGGAATTACCCAACTTGGCCATATAAGAGAG
GAGCCACCTGCAGTGCCTGCCCCAATAATGACAAGTGTTTGGACAATCTCTGTGTTAACCGACAGCGAGACCAAGTG
AAACGTTACTACTCTGTTGTATATCCAGGCTGGCCCATATATCCACGTAACAGATACACTTCTCTCTTTCTCATTGT
TAATTCAGTAATTCTAATACTGTCTGTTATAATTACCATTTTGGTACAGCTCAAGTACCCTAATTTAGTTCTTTTGG
ACTAATACAATTCAGGAAAGAAAAAACCCAAAAACCAACCTCATTCACATATGGCTTTTTTTTAACCAATAACAATT
AGGTGTACTTCTATTTTAAAACATTTCAGAAAAAAATATATGTTATAGCAATACTCTTAC

FIGURE 68A

GTCCCCATGACCTCCTAAAGTGGTGCGGTCCCTGCTGAGTGCGCTGCCCGGGCCGTGACCCGCGCCCCTGTGCGTCC
CCGCGCGCCTCCGAGCGCCCCTGTGCGCCCCGGCCCGCGCCCCGCCGGCATGGACGTCCATACCCGCTGGAAAGCGC
GCAGCGCGCTCCGCCCGGGCGCCCCGCTGCTGCCCCCGCTGCTGCTGCTGCTGCTGTGGGCGCCGCCTCCGAGCCGC
GCAGCTCAGCCAGCAGATCTCCTGAAGGTTCTAGATTTTCACAACTTGCCTGATGGAATAACAAAGACAACAGGCTT
TTGCGCCACGCGGCGATCTTCCAAAGGCCCGGATGTCGCTTACAGAGTCACCAAAGACGCGCAGCTCAGCGCACCCA
CCAAGCAGCTGTACCCTGCGTCTGCATTTCCCGAGGACTTCTCCATCCTAACAACTGTGAAAGCCAAGAAAGGCAGC
CAGGCCTTCCTGGTCTCCATCTACAACGAGCAGGGTATCCAGCAGATTGGGCTGGAGCTGGGCCGCTCTCCCGTCTT
CCTCTACGAGGACCACACGGGGAAGCCTGGCCCGGAAGACTACCCCCTCTTCCGGGGCATCAACCTGTCAGATGGCA
AGTGGCACAGAATTGCTCTCAGCGTCCACAAGAAAAATGTCACCTTGATCCTCGACTGTAAAAAGAAGACCACCAAA
TTCCTCGACCGCAGCGACCACCCCATGATCGACATCAATGGCATCATCGTGTTTGGCACCCGGATCCTGGATGAGGA
GGTGTTTGAGGGTGACATCCAGCAGCTGCTCTTTGTCTCGGACCACCGGGCAGCTTATGATTACTGTGAGCACTACA
GCCCTGACTGTGACACCGCAGTACCTGACACCCCACAGTCGCAGGACCCCAATCCAGATGAATATTACACGGAAGGA
GACGGCGAGGGTGAGACCTATTACTACGAATACCCCTACTACGAAGACCCCGAAGACCTAGGGAAGGAGCCCACCCC
CAGCAAGAAGCCCGTGGAAGCTGCCAAAGAAACCACAGAGGTCCCCGAGGAGCTGACCCCGACCCCCACGGAAGCTG
CTCCCATGCCTGAAACCAGTGAAGGGGCTGGGAAGGAAGAGGACGTCGGCATCGGGGACTATGACTACGTGCCCAGT
GAGGACTACTACACGCCCTCACCGTATGATGACCTCACCTATGGCGAGGGGGAGGAGAACCCTGACCAGCCCACAGA
CCCAGGCGCTGGGGCCGAAATTCCCACCAGCACCGCCGACACCTCCAACTCCTCCAATCCAGCTCCGCCTCCAGGGG
AAGGTGCGGATGACTTGGAGGGGGAGTTCACTGAGGAAACGATCCGGAACCTTGACGAGAACTACTACGACCCCTAC
TACGACCCCACCAGCTCCCCGTCGGAGATCGGGCCGGGAATGCCGGCGAACCAGGATACCATCTATGAAGGGATTGG
AGGACCTCGGGGCGAGAAAGGCCAAAAGGGAGAACCAGCGATTATCGAGCCGGGCATGCTCATCGAGGGCCCGCCTG
GCCCAGAAGGCCCCGCGGGTCTTCCCGGACCTCCAGGAACCATGGGTCCCACTGGCCAAGTCGGGGACCCTGGAGAA
AGGGGCCCCCCTGGACGCCCAGGCCTTCCTGGGGCCGATGGCCTGCCCGGTCCTCCAGGAACCATGCTCATGCTGCC
CTTCCGGTTTGGAGGTGGCGGCGATGCGGGCTCCAAAGGCCCCATGGTCTCAGCCCAGGAGTCCCAGGCGCAAGCCA
TTCTCCAGCAGGCCAGGTTGGCACTGAGGGGACCAGCTGGCCCGATGGGTCTCACAGGGAGACCTGGCCCTGTGGGT
CCCCCTGGAGCGGAGGTTTGAAGGGCGAGCCGGGAGACGTGGGGCCTCAGGGTCCTCGAGGTGTGCAAGGCCCGCC
TGGTCCGGCCGGGAAGCCCGGAAGACGGGGTCGGGCTGGGAGTGATGGAGCCAGAGGAATGCCTGGACAAACTGGCC
CCAAGGGTGACCGGGGTTTCGACGGCCTGGCTGGGTTGCCAGGCGAGAAGGGCCACAGGGGTGACCCTGGTCCTTCC
GGCCCACCAGGACCTCCGGGAGACGATGGAGAAAGGGGTGACGACGGAGAAGTTGGGCCCAGGGGGCTGCCTGGGAA
GCCCGGGCCACGTGGTCTGCTTGGCCGAAAGGGCCCCCAGGTCCTCCCGGACCTCCCGGTGTCACGGGTATGGACG
GCCAGCCGGGGCCAAAAGGAAATGTGGGTCCCCAGGGAGAGCCTGGCCCCCCAGGACAGCAGGGTAATCCAGGCGCC
CAGGGTCTTCCAGGCCCCCAGGGTGCAATTGGTCCTCCAGGAGAAAAGGGTCCCTTGGGGAAACCAGGCCTTCCAGG
AATGCCCGGTGCTGACGGACCCCCGGGACACCCTGGCAAAGAAGGCCCTCCAGGAGAGAAAGGAGGTCAGGGTCCAC
CTGGCCCCCAGGGTCCGATTGGCTACCCAGGTCCTCGAGGAGTCAAGGGGGCCGATGGCATCCGTGGTCTGAAGGGC
ACAAAGGGCGAGAAGGGTGAAGACGGCTTTCCTGGGTTTAAAGGAGACATGGGCATCAAGGGTGATCGGGGGGAGAT
CGGCCCACCCGGTCCCAGGGGAGAAGATGGCCCTGAAGGCCCAAAGGGTCGCGGAGGTCCCAATGGTGACCCCGGTC
CTCTGGGACCCCCTGGGGAGAAGGGAAAACTCGGAGTCCCAGGGTTACCAGGGTATCCAGGAAGACAAGGACCAAAG
GGCTCTATTGGATTCCCTGGATTTCCTGGCGCCAATGGAGAGAAGGGCGGCAGGGGGACCCCTGGAAAGCCAGGACC
GCGGGGGCAGCGAGGCCCAACGGGTCCGAGGGGTGAAAGAGGCCCCCGGGGCATCACTGGAAGCCTGGCCCCAAGG
GCAACTCCGGAGGTGACGGCCCAGCTGGCCCTCCTGGTGAACGGGGACCCAATGGACCCCAAGGACCCACAGGATTT
CCTGGACCAAAGGGCCCCCCTGGCCCTCCAGGCAAGGATGGACTCCCAGGACACCCTGGACAGAGAGGCGAGACTGG
TTTCCAAGGCAAGACCGGCCCTCCAGGCCCCCCGGCGTGGTCGGCCCTCAGGGTCCCACGGGAGAAACGGCCCAA
TGGGTGAGCGTGGCCACCCTGGCCCCCTGGACCCCCGGTGAACAGGGGCTTCCGGGCCTTGCTGGAAAAGAAGGG
ACGAAGGGTGACCCAGGCCCTGCAGGCCTCCCTGGGAAAGATGGCCCTCCAGGATTACGTGGTTTCCCTGGGGACCG
AGGGCTTCCTGGTCCAGTGGAGCTCTTGGACTGAAAGGCAATGAAGGGCCCCCTGGCCCACCAGGCCCTGCGGGAT
CTCCAGGGGAGAGAGGTCCAGCTGGAGCCGCTGGGCCCATCGGAATTCCAGGGAGACCTGGGCCCCAGGGACCCCCA
GGGCCGGCAGGAGAGAAAGGGGCTCCTGGCGAGAAAGGCCCACAAGGCCCAGCTGGCCGAGACGGTCTCCAGGGGCC
TGTGGGGCTCCCGGGTCCAGCTGGCCCTGTGGGTCCCCCTGGAGAAGACGGAGATAAGGGAGAGATCGGGGAGCCGG
GGCAGAAAGGAAGCAAGGGGGACAAAGGAGAACAGGGTCCTCCTGGGCCTACAGGTCCTCAAGGCCCCATCGGACAG
CCAGGCCCCTCTGGAGCTGACGGCGAGCCGGGGCCTCGGGGCCAGCAGGGCCTTTTCGGGCAGAAAGGTGATGAAGG
TCCCAGAGGCTTTCCTGGACCCCCTGGGCCAGTGGGGCTGCAGGGTTTGCCAGGACCTCCAGGCGAGAAGGGTGAGA
CAGGAGACGTGGGCCAGATGGGCCCCCCGGGTCCCCCTGGCCCCCGAGGACCCTCCGGAGCTCCAGGTGCTGATGGC
CCACAAGGTCCCCCAGGTGGAATAGGAAACCCTGGTGCAGTGGGAGAGAAGGGCGAGCCTGGCGAAGCAGGTGAGCC
TGGCCCTTCCGGGAGAAGCGGCCCCCCGGGACCCAAAGGAGAAAGGGGAGAGAAGGGCGAGTCAGGCCCTTCAGGTG
CTGCCGGACCCCCTGGACCCAAAGGCCCTCCCGGAGATGATGGTCCCAAAGGCAGCCCTGGCCCAGTGGGTTTTCCT
GGAGATCCTGGCCCCCCCGGAGAGCCTGGCCCCGCGGGTCAAGATGGTCCCCCTGGTGACAAAGGAGATGATGGTGA
ACCCGGGCAGACGGGATCCCCCGGCCCTACTGGTGAACCAGGTCCATCGGGGCCTCCAGGAAAAAGGGGTCCCCCAG
GCCCCGCAGGCCCCGAAGGCAGACAGGGAGAGAAAGGGGCCAAGGGAGAAGCCGGCTTGGAAGGCCCTCCTGGGAAG
ACTGGCCCCATCGGCCCCCAGGGGGCCCCTGGGAAGCCCGGACCGGATGGCCTTCGAGGGATCCCTGGCCCTGTGGG
AGAACAAGGTCTCCCAGGATCCCCAGGCCCGGACGGTCCCCCCGGCCCCATGGGTCCCCCAGGACTTCCCGGCCTCA
AAGGAGATTCTGGTCCCAAAGGTGAAAAGGGTCATCCAGGCCTGATCGGGCTCATCGGTCCTCCGGGTGAACAGGGT
GAGAAGGGCGACCGTGGTCTCCCTGGCCCCCAGGGCTCCTCCGGTCCTAAGGGAGAACAGGGTATCACTGGTCCTTC
TGGCCCGATTGGGCCTCCTGGGCCCCCTGGCCTGCCGGGTCCGCCTGGTCCAAAAGGTGCTAAGGGCTCCTCGGGTC

FIGURE 68B

CAACTGGCCCGAGGGGTGAGGCAGGCCACCCAGGACCCCCAGGCCCCCCGGGCCCCCCGGGAGAGGTCATCCAGCCC
CTGCCAATCCAGGCATCCAGGACGCGGCGGAACATCGACGCCAGCCAGCTGCTGGACGACGGGAATGGCGAGAACTA
CGTGGACTACGCGGACGGCATGGAAGAGATCTTCGGCTCTCTCAACTCTCTGAAGCTGGAGATTGAGCAGATGAAAC
GGCCCCTGGGCACGCAGCAGAACCCCGCCCGCACCTGCAAGGACCTGCAGCTCTGCCACCCCGACTTCCCAGATGGT
GAATACTGGGTCGATCCTAACCAAGGATGCTCCAGGGATTCCTTCAAGGTTTACTGCAACTTCACAGCCGGGGGGTC
GACATGCGTCTTCCCTGACAAGAAGTCCGAAGGGGCCAGAATCACTTCTTGGCCCAAAGAAAACCCGGGCTCCTGGT
TCAGTGAATTCAAGCGTGGGAAACTGCTCTCCTATGTGGACGCCGAGGGCAACCCTGTGGGTGTGGTACAGATGACC
TTCCTGCGGCTGCTGAGCGCCTCTGCCCACCAGAACGTCACCTACCACTGCTACCAGTCAGTGGCCTGGCAGGACGC
AGCCACGGGCAGCTACGACAAGGCCCTCCGCTTCCTGGGCTCCAACGACGAGGAGATGTCCTATGACAACAACCCCT
ACATCCGCGCCCTGGTGGACGGCTGTGCTACCAAGAAAGGCTACCAGAAGACGGTTCTGGAGATCGACACCCCCAAA
GTGGAGCAGGTGCCCATCGTGGACATCATGTTCAATGACTTCGGTGAAGCGTCACAGAAATTTGGATTTGAAGTGGG
GCCGGCTTGCTTCATGGGCTAGGAGCCGCCGAGCCCGGGCTCCCGAGCCGAATTC

FIGURE 69

CTGGGTGTACAGCGTCCTCGAAACCACGAGCAAGTGAGCAGATCCTCCGAGGCACCAGGGACTCCAGCCCATGCCAT
GGCGGATTCTGAGCGCCTCTCGGCTCCTGGCTGCTGGGCCGCCTGCACCAACTTCTCGCGCACTCGAAAGGGAATCC
TCCTGTTTGCTGAGATTATATTATGCCTGGTGATCCTGATCTGCTTCAGTGCCTCCACACCAGGCTACTCCTCCCTG
TCGGTGATTGAGATGATCCTTGCTGCTATTTTCTTTGTTGTCTACATGTGTGACCTGCACACCAAGATACCATTCAT
CAACTGGCCCTGGAGTGATTTCTTCCGAACCCTCATAGCGGCAATCCTCTACCTGATCACCTCCATTGTTGTCCTTG
TTGAGAGAGGAAACCACTCCAAAATCGTCGCAGGGGTACTGGGCCTAATCGCTACGTGCCTCTTTGGCTATGATGCC
TATGTCACCTTCCCCGTTCGGCAGCCAAGACATACAGCAGCCCCCACTGACCCCGCAGATGGCCCGGTGTAGGCGAA
CTTCCCTCATTTCTCTCTGCAATCTGCAAATAACTCCTCCATTGAAATAACTCCTCCCCACCCCAACAACAACATTC
CCAGCAGACCAACTCCCACCCCCTCTTTGAGGTAAAAGTGCCTTTATTGGGAGACTTTTGTCTTCCAGCCTGCCAAT
CAACCCTCCTGGGTGTGGCCACCATATGTGTGTGCCTAGGTCCTCCTTCTGCACGATCCAATAGGAGACACCAGTTC
TGACTGAACCATGCCCCCACCTAAGTCACAAAATGAGGGAAGTGGGGAGTTAGATTTCAGAGTCCAGGCCCTAGGTT
GGGACCCACTCCAAATAATCTCCTCGGTGTGGGTGGTGGTTCTATAGAGGGATAAATGAATAATAAACATTGTTAAA
ATATACGATAATGAATAAAGTAATCCTTTCATCAAATGTGGGTAAATTTCAAGCATCAGGAGGGGGAAATGGAGTGG
AAACAGCTGGGGCAAGGAGGCAAAGAAGCCAGGCCTGTTTTACAACAAATATTAAATTACTTCAATAATACAAACGAG

FIGURE 70

CGGAAGGAACCGAGAGGGGACGGACAGGAGCTGAGGAGGAAAGAGGAGGGGAGAGGGGTCAGGCCAGGCAGCCAAGG
AGAAGACGTGTGGCCGGGGGCTATCAGAAGGAAACTGGGACGGACGGGCCGGGCTCGGGCTGTCCTGTGGAGCAGCA
GCATCCCCGGGGCCGGCAGAGGCGCCAGTGGCTGGGCGGGATGAGTCTCTGAGGGCCACTGTGGAGCGCCCCGCCAT
GGCCCCCCGCACCCTCTGGAGCTGCTACCTCTGCTGCCTGCTGACGGCAGCTGCAGGGGCCGCCAGCTACCCTCCTC
GAGGTTTCAGCCTCTACACAGGTTCCAGTGGGGCCCTCAGCCCCGGGGGGCCCCAGGCCCAGATTGCCCCCCGGCCA
GCCAGCCGCCACAGGAACTGGTGTGCCTACGTGGTGACCCGGACAGTGAGCTGTGTCCTTGAGGATGGAGTGGAGAC
ATATGTCAAGTACCAGCCTTGTGCCTGGGGCCAGCCCCAGTGTCCCCAAAGCATCATGTACCGCCGCTTCCTCCGCC
CTCGCTACCGTGTGGCCTACAAGACAGTGACCGACATGGAGTGGAGGTGCTGTCAGGGTTATGGGGGCGATGACTGT
GCTGAGAGTCCCGCTCCAGCGCTGGGGCCTGCGTCTTCCACACCACGGCCCCTGGCCCGGCCTGCCCGCCCCAACCT
CTCTGGCTCCAGTGCAGGCAGCCCCCTCAGTGGACTGGGGGGAGAAGGTCCTGGGGAGTCAGAGAAGGTGCAGCAGC
TGGAGGAACAGGTGCAGAGCCTGACCAAGGAGCTGCAAGGCCTGCGGGGCGTCCTGCAAGGACTGAGCGGGCGCCTG
GCAGAGGATGTGCAGAGGGCTGTGGAGACGGCCTTCAACGGGAGGCAGCAGCCAGCTGACGCGGCTGCCCGCCCTGG
GGTGCATGAAACCCTCAATGAGATCCAGCACCAGCTGCAGCTCCTGGACACCCGCGTCTCCACCCACGACCAGGAGC
TGGGTCACCTCAACAACCATCATGGCGGCAGCAGCAGCAGTGGGGGCAGCAGGGCCCCAGCCCCAGCCTCAGCCCCT
CCGGGCCCCAGTGAGGAGCTGCTGCGGCAGCTGGAGCAGCGGTTGCAGGAGTCCTGCTCCGTGTGCCTGGCCGGGCT
AGATGGCTTCCGCCGGCAGCAGCAGGAGGACAGGGAGCGGCTGCGAGCGATGGAGAAGCTGCTGGCCTCGGTGGAGG
AGCGGCAACGGCACCTCGCAGGGCTGGCGGTGGGCCGCAGGCCCCCTCAGGAATGCTGCTCTCCAGAGCTGGGCCGG
CGACTGGCAGAGCTGGAGCGCAGGCTGGATGTCGTGGCCGGCTCAGTGACAGTGCTGAGTGGGCGGCGAGGCACAGA
GCTGGGAGGAGCCGCGGGGCAGGGAGGCCACCCCCCAGGCTACACCAGCTTGGCCTCCCGCCTGTCTCGCCTGGAGG
ACCGCTTCAACTCCACCCTGGGCCCTTCGGAGGAGCAGGAGGAGAGCTGGCCTGGGGCTCCTGGGGGGCTGAGCCAC
TGGCTGCCTGCTGCCCGGGGCCGACTAGAGCAGTTGGGGGGGCTGCTGGCCAATGTGAGCGGGGAGCTGGGGGGGCG
GTTGGATCTGTTGGAGGAGCAGGTGGCAGGGGCCATGCAGGCATGCGGGCAGCTCTGCTCTGGGGCCCCTGGGGAGC
AGGACTCTCAAGTCAGCGAGATCCTCAGTGCCTTGGAGCGCAGGGTGCTGGACAGTGAGGGGCAGCTGCGGCTGGTG
GGCTCCGGCCTGCACACGGTGGAAGCAGCGGGGGAGGCCCGGCAGGCCACGCTGGAGGGATTACAAGAGGTTGTGGG
CCGGCTCCAGGATCGTGTGGATGCCCAGGATGAGACAGCTGCAGAGTTCACACTACGGCTGAATCTCACTGCGGCCC
GGCTAGGCCAACTGGAGGGGCTGCTGCAGGCCCATGGGGATGAGGGCTGTGGGGCCTGTGGCGGAGTCCAAGAGGAA
CTAGGCCGCCTTCGGGATGGTGTGGAGCGCTGCTCCTGCCCCCTGTTGCCTCCTCGGGGTCCTGGGGCTGGTCCAGG
TGTTGGGGGCCCAAGCCGTGGGCCCCTGGACGGCTTCAGCGTGTTTGGGGGCAGCTCAGGCTCAGCCCTGCAGGCCC
TGCAAGGAGAGCTCTCTGAGGTTATTCTCAGCTTCAGCTCCCTCAATGACTCACTGAATGAGCTCCAGACCACTGTG
GAGGGCCAGGGCGCTGATCTGGCTGACCTGGGGGCAACCAAGGACCGTATCATTTCTGAGATTAACAGGCTGCAGCA
GGAGGCCACAGAGCATGCTACAGAGAGTGAAGAGCGCTTCCGAGGCCTAGAGGAGGGACAAGCACAGGCCGGCCAGT
GCCCCAGCTTAGAGGGGCGATTGGGCCGTCTTGAGGGTGTCTGTGAACGGTTGGACACTGTGGCTGGGGGACTGCAG
GGCCTGCGCGAGGGCCTTTCCAGACACGTGGCTGGGCTCTGGGCTGGGCTCCGGGAAACCAACACCACCAGCCAGAT
GCAGGCAGCCCTGCTGGAGAAGCTGGTCGGGGGACAGGCGGGCCTGGGCAGGCGGCTGGGTGCCCTTAACAGCTCCC
TGCAGCTCCTGGAGGACCGTCTGCACCAGCTCAGCCTGAAGGACCTCACTGGGCCTGCAGGAGAGGCTGGGCCCCCA
GGGCCTCCTGGGCTGCAGGGACCCCCAGGCCCTGCTGGACCTCCAGGATCACCAGGCAAGGACGGGCAAGAGGGCCC
CATCGGGCCACCAGGTCCTCAAGGTGAACAGGGAGTGGAGGGGGCACCAGCAGCCCCTGTGCCCCAAGTGGCATTTT
CAGCTGCTCTGAGTTTGCCCCGGTCTGAACCAGGCACGGTCCCCTTCGACAGAGTCCTGCTCAATGATGGAGGCTAT
TATGATCCAGAGACAGGCGTGTTCACAGCGCCACTGGCTGGACGCTACTTGCTGAGCGCGGTGCTGACTGGGCACCG
GCACGAGAAAGTGGAGGCCGTGCTGTCCCGCTCCAACCAGGGCGTGGCCCGCGTAGACTCCGGTGGCTACGAGCCTG
AGGGCCTGGAGAATAAGCCGGTGGCCGAGAGCCAGCCCAGCCCGGGCACCCTGGGCGTCTTCAGCCTCATCCTGCCG
CTGCAGGCCGGGGACACGGTCTGCGTCGACCTGGTCATGGGGCAGCTGGCGCACTCGGAGGAGCCGCTCACCATCTT
CAGCGGGGCCCTGCTCTATGGGGACCCAGAGCTTGAACACGCGTAGACTGGGGTCCCGCCCGACGTGTCTACGTCGG
CTGAAGAGACAGCGGGGGCGGCGGGCTCCTGGGGTCTCGCCTGAGACGGGGCACCTAGCCCTGGGCGAGCGCCGCAC
CCGGGCCCGCAGCGGCACCGCGCCCAGAGCGGCCTCTCCCCACGCCCGGGGCGCGCCGGCTCAGGGAGGCTCGGGGC
CGCCCATGCAGACTTTTGGCCTGGCGCGATCCCCCAAGAACCCCTCCAGGGCCGGCCTGCGGAGGAGCCGATCCTCG
CACCCTCCGCTCCCTCCACTGGCCCTCCAGGTCGATTCCCTGGGCTCCAGGCTCCCCCGCGCGGGCGCCGCCCACCG
CCATACTAAACGATCGAGGAATAAAGACACTTGGTTTTTCTAAAAAAA

FIGURE 71

AAACTGGGAGAGGGAGGAAGGGAGAAAGTGAGAAGGGAAATCGGAAAGAGAAAAGGGAGGAAACGGCAGAGCCAGAG
AGAAAGAGGAAGAGACTGAGTGTGAAGGAGAGAGGACACAGGGGATGACTGAGAGACAGAGAGAGAGAGAGAGAGAG
AATGAGACAGAGACTTAAGGAAGAGACCCTGTGAGTCTGACAATAAAAGATTTGGACAGAAACAGAAAGATTGGAGA
GAGAGAGAGAGGGAGAGAATGAGTGAGAGAGAGACTGGAAGAGACAGAGATCAGAGGGAGACACAGAAAGTGAGAGT
GGGGAGAGAGGTAGTGTAAAAGGAAGAGAGAGAGAGAGAGACCGTAAGAGACAGGAGACAAAGAGACAAAAAGTGTG
AGTGAGCAGGTGAGGAGAGAGATTGAGAACTATGAGAGACAGCAGCTAAGAGACAAAGGAGGCGGGAGACTGCCTAG
GTGCCGCAGCACCCACACCGTCCTCTTGCCCCCCCGTCACTGGGACCCCAGAGCTGGCCCTTGATGGAGGGGAGCCG
ACCTCGCAGCAGCCTGAGCCTGGCCAGCAGCGCCTCCACCATCTCCTCGCTCAGCAGCCTGAGCCCCAAGAAGCCCA
CCCGGGCAGTAAACAAGATCCACGCCTTTGGGAAGAGAGGCAATGCGCTCAGGAGGGATCCCAACCTTCCCGTGCAC
ATCCGAGGCTGGCTTCATAAGCAGGACAGCTCGGGGCTCCGTCTCTGGAAACGCCGCTGGTTCGTCCTCTCCGGCCA
TTGCCTCTTTTATTACAAGGACAGCCGCGAGGAGAGTGTCCTAGGCAGCGTCCTGCTCCCCAGCTACAATATTAGAC
CAGATGGGCCGGGAGCCCCCCGAGGGCGGCGCTTCACCTTCACCGCAGAGCACCCGGGCATGAGGACCTACGTTTTG
GCCGCTGACACCTTAGAAGACCTGCGGGGCTGGCTACGGGCGCTGGGCCGGGCCTCCCGTGCGGAGGGGGACGACTA
TGGGCAACCCAGGTCACCTGCACGACCCCAGCCCGGGGAGGGCCCCGGCGGCCCCGGTGGTCCCCCGGAGGTGAGCA
GAGGGGAAGAGGGGCGCATCTCAGAATCACCGGAAGTGACTCGACTCTCCAGAGGTCGTGGTAGACCCAGGCTGCTC
ACTCCCAGCCCCACAACCGACCTCCACTCTGGACTCCAGATGCGGAGGGCGAGGAGCCCCGACCTGTTCACCCCCCT
CTCTCGCCCTCCCTCGCCTCTGAGCCTCCCCCGTCCCCGTTCTGCCCCTGCGCGGCGACCCCCTGCCCCCTCAGGAG
ACACAGCACCCCCTGCCCGACCTCACACCCCGTTGAGTCGCATTGATGTCCGACCTCCTCTGGATTGGGGCCCCCAA
CGCCAGACCCTCTCCCGACCCCCTACTCCCCGCCGAGGACCTCCCTCTGAGGCTGGGGGAGGAAAGCCCCCCAGGAG
TCCCCAGCACTGGAGTCAGGAGCCCAGAACACAGGCACACTCTGGCTCCCCCACTTATCTCCAGCTCCCCCCGCGGC
CCCCTGGGACCCGGGCCTCCATGGTTTTATTGCCGGGTCCTCCCCTGGAGTCAACTTTCCACCAAAGCTTGGAGACA
GATACGCTGCTGACCAAGTTGTGCGGGCAGGACCGGCTTCTGCGGAGGCTGCAGGAGGAGATAGACCAGAAGCAGGA
GGAGAAGGAGCAACTAGAAGCAGCTCTGGAGTTGACCCGGCAACAGCTGGGCCAAGCCACCAGGGAGGCTGGGGCTC
CCGGGAGGGCCTGGGGTCGCCAGCGCCTCTTGCAGGACCGGCTGGTCAGTGTGAGGGCCACCCTCTGTCACTTGACT
CAGGAGCGAGAGAGGGTTTGGGACACGTACAGTGGCCTGGAGCAGGAGCTGGGCACCTTAAGAGAGACGCTGGAGTA
CCTGCTGCACCTTGGTTCTCCCCAGGACAGAGTGTCTGCTCAGCAGCAGCTGTGGATGGTGGAAGACACGCTGGCAG
GTCTGGGTGGCCCCCAGAAACCGCCCCCACACACTGAGCCTGACTCCCCATCTCCCGTGCTCCAGGGCGAGGAGTCC
TCAGAGAGGGAGAGCCTGCCAGAGTCCTTGGAACTGAGCTCCCCTAGGTCCCCCGAGACTGACTGGGGGCGGCCTCC
TGGAGGCGACAAAGACCTCGCCAGCCCTCACTTAGGTCTTGGGTCTCCGAGGGTCTCCCGGGCTTCCAGCCCTGAGG
GTCGCCACCTCCCTTCCCCACAGCTAGGAACCAAGGCCCCGGTGGCCCGGCCCCGGATGAATGCCCAGGAGCAGCTG
GAGCGGATGCGCAGAAACCAGGAATGTGGACGGCCCTTCCCTCGCCCGACCTCCCCCCGGCTTCTCACCCTGGGAAG
GACACTGTCCCCAGCCAGACGCCAGCCTGACGTGGAGCAAAGGCCTGTCGTAGGACACTCGGGAGCCCAGAAATGGC
TCAGAAGCTCTGGGTCCTGGAGTAGTCCAAGGAACACCACCCCTTACTTGCCGACTTCCGAAGGTCACCGGGAGCGG
GTTCTCAGCCTCTCCCAAGCCCTGGCTACTGAGGCGTCGCAGTGGCACAGAATGATGACAGGTGGAAATTTGGACTC
CCAGGGAGACCCTCTTCCCGGTGTGCCGCTGCCTCCTTCGGACCCCACGCGCCAGGAGACCCCTCCCCCCAGATCTC
CCCCGGTGGCTAATTCGGGTTCCACGGGGTTCTCTCGCCGAGGGAGTGGGCGTGGAGGAGGTCCCACCCCCTGGGGG
CCCGCGTGGGATGCCGGGATCGCCCCTCCGGTCCTGCCACAAGACGAGGGGGCATGGCCTCTGCGAGTCACTCTGCT
ACAATCCAGCTTGTAATCCGCCCAAAAGCGGCAGCCAATCGGAGCGCGAGGACGTGGTCTGGAGGTACCGCCGAAGA
TCTGGGACCACTCAGGGCATCAGGGGGCGTGGTCTGGTCCCCATTGCGGGCCCGGGAGGGGAATGGTTTCTATGGCC
AAAGTTTGGTTTTCTCAACACTGTCTAAATTTGGATTAAAACTTTGAACTTTT

FIGURE 72

ACTTCTTCGCACCAGGGAAGCCCCACCCACCAGAACGCCAAGATGTCCAGCAAGCGGGCCAAAGCCAAGGCCACCAA
GAAGCGGCCACAGCGGGCCACATCCAATGTCTTCGCAATGTTTGACCAGTCCCAGATCCAGGAGTTTAAGGAGGCTT
TCAACATGATTGACCAGAACCGTGATGGCTTCATTGACAAGGAGGACCTGCACGACATGCTGGCCTCGCTGGGGAAG
AACCCCACAGACGAATACCTGGAGGGCATGATGAGCGAGGCCCCGGGGCCATACAACTTCACCATGTTCCTCACCAT
GTTTGGGGAGAAGCTGAACGGCACGGACCCCGAGGATGTGATTCGCAACGCCTTTGCCTGCTTCGACGAGGAATCCT
CAGGTTTCATCCATGAGGACCACCTCCGGAAGCTGCTCACCACCATGGGTGACCGCTTCACAGATGAGGAAGTGGAC
GAGATGTACCGGGAGGCACCCGTTGATAAGAAAGGCAACTTCAACTACGTGGAGTTCACCCGCATCCTCAAACATGG
CGCCAAGGATAAACACGACTAGGCCATCCCCAGCCCCCTGACACCCAGCCCCCGCCAGTCACCCCTCCCCGCACACA
CCCGTCCATACCAGCTCCCTGCCCATGACCCTCGCTCAGGGATCCCCCTTTGAGGGTTAGGGTCCCAGTTCCCAGTG
GAAGAAACAGGCCAGGAGAGTGCGTGCCGAGCTGAGGCAGATGTTCCCACAGTGACCCCAGAGCCCTGGGCTATAGT
CTCTGACCCCTCCAAGGAAAGACCACCTTCTGGGGACATGGGCTGGAGGGCAGGACCTAGAGGCACCAAGGGAACCG
CATTCCGGGGCTGTTCCCCGAGGAGGAAGGGAAGCCTCTGTGTGCCCCCCAGGAGGAAGAGGCCCTGAGTCCTGGGA
TCAGACACCCCTTCACGTGTATCCCACACAAATGCAAGCTCACCAAGGTCCCCTCTCAGTCCCCTTCCCTACACCCT
GACGCCAGATGCCGCACACCCAACGCCACCAGCCATGGGAGTGTGCTCAGGAGTCGCGGGGCAGACGTGACATCTGT
CCAGAGGGGGCAGAATCTCCAATAGAGGACTGAGACAACATG

FIGURE 73

ATCCTGTCTGTCCGAACCCAGACACAAGTCTTCACTCCTTCCTGCGAGCCCTGAGGAAGCCTTCTTTCCCCAGACAT
GGCCAACAAGGGTCCTTCCTATGGCATGAGCCGCGAAGTGCAGTCCAAAATCGAGAAGAAGTATGACGAGGAGCTGG
AGGAGCGGCTGGTGGAGTGGATCATAGTGCAGTGTGGCCCTGATGTGGGCCGCCCAGACCGTGGGCCCTTGGGCTTC
CAGGTGTGGCTGAAGAATGGCGTGATTCTGAGCAAGCTGGTGAACAGCCTGTACCCTGATGGCTCCAAGCCGGTGAA
GGTGCCCGAGAACCCACCCTCCATGGTCTTCAAGCAGATGGAGCAGGTGGCTCAGTTCCTGAAGGCGGCTGAGGACT
CTGGGGTCATCAAGACTGACATGTTCCAGACTGTTGACCTCTTTGAAGGCAAAGACATGGCAGCAGTGCAGAGGACC
CTGATGGCTTTGGGCAGCTTGGCAGTGACCAAGAATGATGGGCACTACCGTGGAGATCCCAACTGGTTTATGAAGAA
AGCGCAGGAGCATAAGAGGGAATTCACAGAGAGCCAGCTGCAGGAGGGAAAGCATGTCATTGGCCTTCAGATGGGCA
GCAACAGAGGGGCCTCCCAGGCCGGCATGACAGGCTACGGACGACCTCGGCAGATCATCAGTTAGAGCGGAGAGGGC
TAGCCCTGAGCCCGGCGCTCCCCCAGCTCCTTGGCTGCAGCCATCCCGCTTAGCCTGCCTCACCCACACCCGTGTGG
TACCTTCAGCCCTGGCCAAGCTTTGAGGCTCTGTCACTGAGCAATGGTAACTGCACCTGGGCAGCTCCTCCCTGTGC
CCCCAGCCTCAGCCCAACTTCTTACCCGAAAGCATCACTGCCTTGGCCCCTCCCTCCCGGCGGCCCCCATCACCTCT
ACTGTCTCCTCCCTGGGCTAAGCAGGGGAGAAGCGGGCTGGGGGTAGCCTGGATGTGGGCGAAGTCCACTGTCCTCC
TTGGCGGCAAAAGCCCATTGAAGAAGAACCAGCCCAGCCTGCCCCCTATCTTGTACCTGGAATATTTTTGGGGTTGG
AACTCTC

FIGURE 74

ATTCTTCCCCTCTCTACAACCCTCTCTCCTCAGCGCTTCTTCTTTCTTGGTTTGATCCTGACTGCTGTCATGGCGTG
CCCTCTGGAGAAGGCCCTGGATGTGATGGTGTCCACCTTCCACAAGTACTCGGGCAAAGAGGGTGACAAGTTCAAGC
TCAACAAGTCAGAACTAAAGGAGCTGCTGACCCGGGAGCTGCCCAGCTTCTTGGGGAAAAGGACAGATGAAGCTGCT
TTCCAGAAGCTGATGAGCAACTTGGACAGCAACAGGGACAACGAGGTGGACTTCCAAGAGTACTGTGTCTTCCTGTC
CTGCATCGCCATGATGTGTAACGAATTCTTTGAAGGCTTCCCAGATAAGCAGCCCAGGAAGAAATGAAAACTCCTCT
GATGTGGTTGGGGGGTCTGCCAGCTGGGGCCCTCCCTGTCGCCAGTGGGCACTTTTTTTTTTCCACCCTGGCTCCTT
CAGACACGTGCTTGATGCTGAGCAAGTTCAATAAAGATTCTTGGAAGTTT

FIGURE 75

CCGTCCCCGGCGGCCCCATGCCCCGATGCCCCGCGGGGGCCATGGACGAGGGGCCCGTGGACCTGCGCACCCGGCCC
AAGGCCGCCGGACTCCCGGGCGCCGCGCTGCCGCTCCGCAAGCGCCCGCTGCGCGCGCCCTCCCCGGAGCCCGCCGC
TCCCCGCGGCGCTGCGGGCCTTGTCGTCCCCCTGGACCCTCTGCGCGGCGGCTGCGACCTGCCGGCGGTCCCCGGGC
CCCCCCACGGCCTGGCCCGGCCGGAGGCGCTTTACTACCCCGGAGCCTTACTGCCTTTGTACCCCACTCGGGCCATG
GGCTCCCCGTTTCCTCTGGTGAACCTGCCTACACCCCTATACCCCATGATGTGCCCCATGGAACACCCCCTTTCTGC
TGACATCGCCATGGCCACCCGTGCAGATGAGGACGGAGACACGCCTCTCCATATTGCTGTGGTGCAGGGTAACCTGC
CAGCTGTGCACCGGCTGGTCAACCTCTTCCAGCAGGGGGGCCGGGAGCTCGACATCTACAACAACCTACGGCAGACA
CCGCTCCACCTGGCTGTGATCACCACATTACCGTCTGTGGTCCGGCTCCTGGTGACAGCTGGTGCCAGCCCCATGGC
GCTGGACCGCCATGGCCAGACGGCCGCTCACCTGGCGTGCGAGCACCGCAGCCCGACCTGCCTGCGAGCCCTGCTGG
ACAGCGCAGCTCCGGGCACGTTGGACCTGGAGGCCCGCAATTATGACGGGCTCACCGCCCTGCACGTGGCAGTGAAC
ACCGAGTGCCAAGAAACCGTGCAGCTCTTGCTAGAGCGCGGTGCCGACATCGACGCAGTGGACATTAAGAGCGGCCG
CTCCCCGCTCATCCACGCCGTGGAAAACAACAGCCTTAGCATGGTGCAGCTGCTGCTGCAGCACGGCGCCAACGTGA
ACGCGCAAATGTACTCCGGCAGCTCCGCCCTGCACTCAGCGTCCGGCCGCGGGCTCCTCCCGCTGGTGCGCACGCTG
GTCCGCAGCGGCGCTGACAGCAGCCTCAAGAACTGCCACAACGACACGCCGCTCATGGTGGCGCGCAGCCGCAGGGT
CATCGACATCCTGAGGGGGAAGGCCACCCGGCCTGCTTCCACCTCCCAGCCAGACCCCTCCCCTGACCGGAGCGCCA
ACACCTCCCCCGAGAGCAGCAGCCGCCTCAGCTCCAATGGTCTTCTCTCCGCATCACCATCCTCCTCACCCTCCCAG
TCTCCCCCCAGGGACCCCCCTGGATTCCCCATGGCTCCTCCCAATTTCTTCCTTCCTTCCCCATCTCCACCCGCCTT
CCTGCCCTTTGCTGGGGTCCTCCGAGGCCCTGGCCGGCCGGTGCCCCCCTCCCCAGCTCCAGGAGGCAGCTGAGGGG
GATGGGGGGGCAGATCTTGGACTCATGAGGAGGGGCCCCCCTGCCCAGAGGGGTCAACCCTTCTGGAAACTGTGAAG
ATCTGACTTCGCCCCCCCCCCCCCCCATCTTCGGGACCAGGATTTGCACAGAAGCACATGCACCTACCCATACACCC
CCTCTTCTGAGCGTCCCTGTTCCCCCATCTCGCTCCCTCCCAGGACTCTGACCCCAGCATTCTCAGGCACCAGTCCC
TGTCCGGAATGCCACCCACATCTTCCATTTCCATGTCCCCTCCCAGAGCTGGTGGACCCAGGGAACAGCCACTCCCC
TCCACTCTCTACCAGATAACTGAGGAGGGGAGAGGTGGGCCGTAACGGGCACGGATCACGATGTAAATTATTAAGCA
TTTTGGTTGGATTTCTTTTGTAATAAACTATTTTTGTACCAT

FIGURE 76

ATCATGTACCAGGATTATCCCGGGAACTTTGACACCTCGTCCCGGGGCAGCAGCGGCTCTCCTGCGCACGCCGAGTC
CTACTCCAGCGGCGGCGGCGGCCAGCAGAAATTCCGGGTAGATATGCCTGGCTCAGGCAGTGCATTCATCCCCACCA
TCAACGCCATCACGACCAGCCAGGACCTGCAGTGGATGGTGCAGCCCACAGTGATCACCTCCATGTCCAACCCATAC
CCTCGCTCGCACCCCTACAGCCCCCTGCCGGGCCTGGCCTCTGTCCCTGGACACATGGCCCTCCCAAGACCTGGCGT
GATCAAGACCATTGGCACCACCGTGGGCCGCAGGAGGAGAGATGAGCAGCTGTCTCCTGAAGAGGAGGAGAAGCGTC
GCATCCGGCGGGAGAGGAACAAGCTGGCTGCAGCCAAGTGCCGGAACCGACGCCGGGAGCTGACAGAGAAGCTGCAG
GCGGAGACAGAGGAGCTGGAGGAGGAGAAGTCAGGCCTGCAGAAGGAGATTGCTGAGCTGCAGAAGGAGAAGGAGAA
GCTGGAGTTCATGTTGGTGGCTCACGGCCCAGTGTGCAAGATTAGCCCCGAGGAGCGCCGATCGCCCCCAGCCCCTG
GGCTGCAGCCCATGCGCAGTGGGGGTGGCTCGGTGGGCGCTGTAGTGGTGAAACAGGAGCCCCTGGAAGAGGACAGC
CCCTCGTCCTCGTCGGCGGGGCTGGACAAGGCCCAGCGCTCTGTCATCAAGCCCATCAGCATTGCTGGGGGCTTCTA
CGGTGAGGAGCCCCTGCACACCCCCATCGTGGTGACCTCCACACCTGCTGTCACTCCGGGCACCTCGAACCTCGTCT
TCACCTATCCTAGCGTCCTGGAGCAGGAGTCACCCGCATCTCCCTCCGAATCCTGCTCCAAGGCTCACCGCAGAAGC
AGTAGCAGCGGGGACCAATCATCAGACTCCTTGAACTCCCCCACTCTGCTGGCTCTGTAACCCAGTGCACCTCCCTC
CGGAGC

FIGURE 77

TGAACTCTGGATGCTGTTAGCCTGAGACTCAGGAAGACAACTTCTGCAGGGTCACTCCCTGGCTTCTGGAGGAAAGA
GAAGGAGGGCAGTGCTCCAGTGGTACAGAAGTGAGACATAATGGAATCAGGCTTCACCTCCAAGGACACCTATCTAA
GCCATTTTAACCCTCGGGATTACCTAGAAAAATATTACAAGTTTGGTTCTAGGCACTCTGCAGAAAGCCAGATTCTT
AAGCACCTTCTGAAAAATCTTTTCAAGATATTCTGCCTAGACGGTGTGAAGGGAGACCTGCTGATTGACATCGGCTC
TGGCCCCACTATCTATCAGCTCCTCTCTGCTTGTGAATCCTTTAAGGAGATCGTCGTCACTGACTACTCAGACCAGA
ACCTGCAGGAGCTGGAGAAGTGGCTGAAGAAAGAGCCAGAGGCCTTTGACTGGTCCCCAGTGGTGACCTATGTGTGT
GATCTTGAAGGGAACAGAGTCAAGGGTCCAGAGAAGGAGGAGAAGTTGAGACAGGCGGTCAAGCAGGTGCTGAAGTG
TGATGTGACTCAGAGCCAGCCACTGGGGGCCGTCCCCTTACCCCCGGCTGACTGCGTGCTCAGCACACTGTGTCTGG
ATGCCGCCTGCCCAGACCTCCCCACCTACTGCAGGGCGCTCAGGAACCTCGGCAGCCTACTGAAGCCAGGGGGCTTC
CTGGTGATCATGGATGCGCTCAAGAGCAGCTACTACATGATTGGTGAGCAGAAGTTCTCCAGCCTCCCCCTGGGCCG
GGAGGCAGTAGAGGCTGCTGTGAAAGAGGCTGGCTACACAATCGAATGGTTTGAGGTGATCTCGCAAAGTTATTCTT
CCACCATGGCCAACAACGAAGGACTTTTCTCCCTGGTGGCGAGGAAGCTGAGCAGACCCCTGTGATGCCTGTGACCT
CAATTAAAGCAATTCCTTTGACCTGTCA

FIGURE 78

GCCCTTGCCTTGAGTCAGTGCGCTGCTCTCCAGCCCGCTTGAACGCTCCCCGCAGCCACCGCCACCCATTGGAATGG
CCAACAGGGGACCTGCATATGGCCTGAGCCGGGAGGTGCAGCAGAAGATTGAGAAACAATATGATGCAGATCTGGAG
CAGATCCTGATCCAGTGGATCACCACCCAGTGCCGAAAGGATGTGGGCCGGCCCCAGCCTGGACGCGAGAACTTCCA
GAACTGGCTCAAGGATGGCACGGTGCTATGTGAGCTCATTAATGCACTGTACCCCGAGGGGCAGGCCCCAGTAAAGA
AGATCCAGGCCTCCACCATGGCCTTCAAGCAGATGGAGCAGATCTCTCAGTTCCTGCAAGCAGCTGAGCGCTATGGC
ATTAACACCACTGACATCTTCCAAACTGTGGACCTCTGGGAAGGAAAGAACATGGCCTGTGTGCAGCGGACGCTGAT
GAATCTGGGTGGGCTGGCAGTAGCCCGAGATGATGGGCTCTTCTCTGGGGATCCCAACTGGTTCCCTAAGAAATCCA
AGGAGAATCCTCGGAACTTCTCAGATAACCAGCTGCAAGAGGGCAAGAACGTGATCGGGTTACAGATGGGCACCAAC
CGCGGGGCGTCTCAGGCAGGCATGACTGGCTACGGGATGCCACGCCAGATCCTCTGATCCCACCCCAGGCCTTGCCC
CTGCCCTCCCACGAATGGTTAATATATATGTAGATATATATTTTAGCAGTGACATTCCCAGAGAGCCCCAGAGCTCT
CAAGCTCCTTTCTGTCAGGGTGGGGGGTTCAGCCTGTCCTGTCACCTCTGAGGTGCCTGCTGGCATCCTCTCCCCCA
TGCTTACTAATACATTCCCTTCCCCATAGCCATCAAAACTGGACCAACTGGCCTCTTCCTTTCCCCTGGGACCAAAA
TTTAGGGGCCTCAGTCCCTCACCGCCATGCCCTGGCCTATTCTGTCTCTCCTTCTTCCCCCTGGCCTGTTCTGTCTC
TGAGCTCTGTGTCCTCCGTTCATTCCATGGCTGGGAGTCACTGATGCTGCCTCTGCCTTCTGATGCTGGACTGGCCT
TGCTTCTACAAGTATGCTTCTCCCACAGCTGTGGCTGCAGGAACTTAATTTATAGGGAGGAGCCTGTGGCAGCTGCT
GCCCCAGCCACAGCTGCACTGACTGTGCTCACCACACATCTGGGGCAGCCTTCCCTGGCAGGGGCCCTCGTGGCTTC
TCATTTTCCATTCCCTTCACTGTGGCTAAGGGGTGGGGTGAGGGGATGGAGAGGGAGGGCTGCCTACCATGGTCTGG
GGCTTGAGGAAGATGAGTTTGTTGATTTAAATAAAGAATTTGTCATTTTTG

FIGURE 79

GGCCAGCCGAATCCAAGCCGTGTGTACTGCGTGCTCAGCACTGCCCGACAGTCCTAGCTAAACTTCGCCAACTCCGC
TGCCTTTGCCGCCACCATGCCCAAAACGATCAGTGTGCGTGTGACCACCATGGATGCAGAGCTGGAGTTTGCCATCC
AGCCCAACACCACCGGGAAGCAGCTATTTGACCAGGTGGTGAAAACTATTGGCTTGAGGGAAGTTTGGTTCTTTGGT
CTGCAGTACCAGGACACTAAAGGTTTCTCCACCTGGCTGAAACTCAATAAGAAGGTGACTGCCCAGGATGTGCGGAA
GGAAAGCCCCCTGCTCTTTAAGTTCCGTGCCAAGTTCTACCCTGAGGATGTGTCCGAGGAATTGATTCAGGACATCA
CTCAGCGCCTGTTCTTTCTGCAAGTGAAAGAGGGCATTCTCAATGATGATATTTACTGCCCGCCTGAGACCGCTGTG
CTGCTGGCCTCGTATGCTGTCCAGTCTAAGTATGGCGACTTCAATAAGGAAGTGCATAAGTCTGGCTACCTGGCCGG
AGACAAGTTGCTCCCGCAGAGAGTCCTGGAACAGCACAAACTCAACAAGGACCAGTGGGAGGAGCGGATCCAGGTGT
GGCATGAGGAACACCGTGGCATGCTCAGGGAGGATGCTGTCCTGGAATATCTGAAGATTGCTCAAGATCTGGAGATG
TATGGTGTGAACTACTTCAGCATCAAGAACAAGAAAGGCTCAGAGCTGTGGCTGGGGGTGGATGCCCTGGGTCTCAA
CATCTATGAGCAGAATGACAGACTAACTCCCAAGATAGGCTTCCCCTGGAGTGAAATCAGGAACATCTCTTTCAATG
ATAAGAAATTTGTCATCAAGCCCATTGACAAAAAAGCCCCGGACTTCGTCTTCTATGCTCCCCGGCTGCGGATTAAC
AAGCGGATCTTGGCCTTGTGCATGGGGAACCATGAACTATACATGCGCCGTCGCAAGCCTGATACCATTGAGGTGCA
GCAGATGAAGGCACAGGCCCGGGAGGAGAAGCACCAGAAGCAGATGGAGCGTGCTATGCTGGAAAATGAGAAGAAGA
AGCGTGAAATGGCAGAGAAGGAGAAAGAGAAGATTGAACGGGAGAAGGAGGAGCTGATGGAGAGGCTGAAGCAGATC
GAGGAACAGACTAAGAAGGCTCAGCAAGAACTGGAAGAACAGACCCGTAGGGCTCTGGAACTTGAGCAGGAACGGAA
GCGTGCCCAGAGCGAGGCTGAAAAGCTGGCCAAGGAGCGTCAAGAAGCTGAAGAGGCCAAGGAGGCCTTGCTGCAGG
CCTCCCGGGACCAGAAAAAGACTCAGGAACAGCTGGCCTTGGAAATGGCAGAGCTGACAGCTCGAATCTCCCAGCTG
GAGATGGCCCGACAGAAGAAGGAGAGTGAGGCTGTGGAGTGGCAGCAGAAGGCCCAGATGGTACAGGAAGACTTGGA
GAAGACCCGTGCTGAGCTGAAGACTGCCATGAGTACACCTCATGTGGCAGAGCCTGCTGAGAATGAGCAGGATGAGC
AGGATGAGAATGGGGCAGAGGCTAGTGCTGACCTACGGGCTGATGCTATGGCCAAGGACCGCAGTGAGGAGGAACGT
ACCACTGAGGCAGAGAAGAATGAGCGTGTGCAGAAGCACCTGAAGGCCCTCACTTCGGAGCTGGCCAATGCCAGAGA
TGAGTCCAAGAAGACTGCCAATGACATGATCCATGCTGAGAACATGCGACTGGGCCGAGACAAATACAAGACCCTGC
GCCAGATCCGGCAGGGCAACACCAAGCAGCGCATTGACGAATTTGAGTCTATGTAATGGGCACCCAGCCTCTAGGGA
CCCCTCCTCCCTTTTTCCTTGTCCCCACACTCCTACACCTAACTCACCTAACTCATACTGTGCTGGAGCCACTAACT
AGAGCAGCCCTGGAGTCATGCCAAGCATTTAATGTAGCCATGGGACCAAACCTAGCCCCTTAGCCCCCACCCACTTC
CCTGGGCAAATGAATGGCTCACTATGGTGCCAATGGAACCTCCTTTCTCTTCTCTGTTCCATTGAATCTGTATGGCT
AGAATATCCTACTTCTCCAGCCTAGAGGTACTTTCCACTTGATTTTGCAAATGCCCTTACACTTACTGTTGTCCTAT
GGGAGTCAAGTGTGGAGTAGGTTGGAAGCTAGCTCCCCTCCTCTCCCCTACCACTGTCTTCTTCAGGGTCCTGAGAT
TTACACGGTTGGAGTGTTATGCGGTCTAGGGAATGAGACAGGACCTAGGATATCTTCTCCAGGATGTCAACTGACCT
AAAATTTGCCCTCCCATCCCGTTTAGAGTTATTTAGGCTTTGTAACGATTGGGGGATAAAAAGATGTTCAGTCATTT
TTGTTTCTACCTCCCAGATCGGATCTGTTGCAAACTCAGCCTCAATAAGCCTTGTCGTTGACTTTAGGGACTCAATT
TCTCCCCAGGGTGGATGGGGGAAATGGTGCCTTCAAGACCTTCACCAAACATACTAGAAGGGCATTGGCCATTCTAT
TGTGGCAAGGCTGAGTAGAAGATCCTACCCCAATTCCTTGTAGGAGTATAGGCCGGTCTAAAGTGAGCTCTATGGGC
AGATCTACCCCTTACTTATTATTCCAGATCTGCAGTCACTTCGTGGGATCTGCCCCTCCCTGCTTCAATACCCAAAT
CCTCTCCAGCTATAACAGTAGGGATGAGTACCCAAAAGCTCAGCCAGCCCCATCAGGACTCTTGTGAAAAGAGAGGA
TATGTTCACACCTAGCGTCAGTATTTTCCCTGCTAGGGGTTTTAGGTCTCTTCCCCTCTCAGAGCTACTTGGGCCAT
AGCTCCTGCTCCACAGCCATCCCAGCCTTGGCATCTAGAGCTTGATGCCAGTAGGCTCAACTAGGGAGTGAGTGCAA
AAAGCTGAGTATGGTGAGAGAAGCCTGTGCCCTGATCCAAGTTTACTCAACCCTCTCAGGTGACCAAAATCCCCTTC
TCATCACTCCCCTCCAAAGAGGTGACTGGGCCCTGCCTCTGTTTGACAAACCTCTAACCCAGGTCTTGACACCAGCT
GTTCTGTCCCTTGGAGCTGTAAACCAGAGAGCTGCTGGGGATTCTGGCCTAGTCCCTTCCACACCCCCACCCCTTGC
TCTCAACCCAGGAGCATCCACCTCCTTCTCTGTCTCATGTGTGCTCTTCTTCTTTCTACAGTATTATGTACTCTACT
GATATCTAAATATTGATTTCTGCCTTCCTTGCTAATGCACCATTAGAAGATATTAGTCTTGGGGCAGGATGATTTTG
GCCTCATTACTTTACCACCCCCACACCTGGAAAGCATATACTATATTACAAAATGACATTTTGCCAAAATTATTAAT
ATAAGAAGCTTTCAGTATTAGTGATGTCATCTGTCACTATAGGTCATACAATCCATTCTTAAAGTACTTGTTATTTG
TTTTTATTATTACTGTTTGTCTTCTCCCCAGGGTTCAGTCCTCAAGGGGCCATCCTGTCCCACCATGCAGTGCCCCT
AGCTTAGAGCCTCCCTCAATTCCCCCTGGCCACCACCCCCCACTCTGTGCCTGACCTTGAGGAGTCTTGTGTGCATT
GCTGTGAATTAGCTCACTTGGTGATATGTCCTATATTGGCTAAATTGAAACCTGGAATTGTGGGCAATCTATTAAT
AGCTGCCTTAAAGTCAGTAACTTACCCTTAGGGAGGCTGGGGGAAAAGGTTAGATTTTGTATTCAGGGGTTTTTTGT
GTACTTTTTGGGTTTTTTAAAAATTGTTTTTGGAGGGGTTTATGCTCAATCCATGTTCTATTTCAGTGCCAATAAAA
TTTAGGAAGACTTC

FIGURE 80

AGTGTGAAATCTTCAGAGAAGAATTTCTCTTTAGTTCTTTGCAAGAAGGTAGAGATAAAGACACTTTTTCAAAA<u>ATG</u>
GCAATGGTATCAGAATTCCTCAAGCAGGCCTGGTTTATTGAAAATGAAGAGCAGGAATATGTTCAAACTGTGAAGTC
ATCCAAAGGTGGTCCCGGATCAGCGGTGAGCCCCTATCCTACCTTCAATCCATCCTCGGATGTCGCTGCCTTGCATA
AGGCCATAATGGTTAAAGGTGTGGATGAAGCAACCATCATTGACATTCTAACTAAGCGAAACAATGCACAGCGTCAA
CAGATCAAAGCAGCATATCTCCAGGAAACAGGAAAGCCCCTGGATGAAACACTTAAGAAAGCCCTTACAGGTCACCT
TGAGGAGGTTGTTTTAGCTCTGCTAAAAACTCCAGCGCAATTTGATGCTGATGAACTTCGTGCTGCCATGAAGGGCC
TTGGAACTGATGAAGATACTCTAATTGAGATTTTGGCATCAAGAACTAACAAAGAAATCAGAGACATTAACAGGGTC
TACAGAGAGGAACTGAAGAGAGATCTGGCCAAAGACATAACCTCAGACACATCTGGAGATTTTCGGAACGCTTTGCT
TTCTCTTGCTAAGGGTGACCGATCTGAGGACTTTGGTGTGAATGAAGACTTGGCTGATTCAGATGCCAGGGCCTTGT
ATGAAGCAGGAGAAAGGAGAAAGGGGACAGACGTAAACGTGTTCAATACCATCCTTACCACCAGAAGCTATCCACAA
CTTCGCAGAGTGTTTCAGAAATACACCAAGTACAGTAAGCATGACATGAACAAAGTTCTGGACCTGGAGTTGAAAGG
TGACATTGAGAAATGCCTCACAGCTATCGTGAAGTGCGCCACAAGCAAACCAGCTTTCTTTGCAGAGAAGCTTCATC
AAGCCATGAAAGGTGTTGGAACTCGCCATAAGGCATTGATCAGGATTATGGTTTCCCGTTCTGAAATTGACATGAAT
GATATCAAAGCATTCTATCAGAAGATGTATGGTATCTCCCTTTGCCAAGCCATCCTGGATGAAACCAAAGGAGATTA
TGAGAAAATCCTGGTGGCTCTTTGTGGAGGAAAC<u>TAA</u>ACATTCCCTTGATGGTCTCAAGCTATGATCAGAAGACTTT
AATTATATATTTTCATCCTATAAGCTTAAATAGGAAAGTTTCTTCAACAGGATTACAGTGTAGCTACCTACATGCTG
AAAAATATAGCCTTTAAATCATTTTTATATTATAACTCTGTATAATAGAGATAAGTCCATTTTTTAAAAATGTTTTC
CCCAAACCATAAAACCCTATACAAGTTGTTCTAGTAACAATACATGAGAAAGATGTCTATGTAGCTGAAAATAAAAT
GACGTCACAAGAC

FIGURE 81

CATTTGGGGACGCTCTCAGCTCTCGGCGCACGGCCCAGCTTCCTTCAAAATGTCTACTGTTCACGAAATCCTGTGCA
AGCTCAGCTTGGAGGGTGATCACTCTACACCCCCAAGTGCATATGGGTCTGTCAAAGCCTATACTAACTTTGATGCT
GAGCGGGATGCTTTGAACATTGAAACAGCCATCAAGACCAAAGGTGTGGATGAGGTCACCATTGTCAACATTTTGAC
CAACCGCAGCAATGCACAGAGACAGGATATTGCCTTCGCCTACCAGAGAAGGACCAAAAAGGAACTTGCATCAGCAC
TGAAGTCAGCCTTATCTGGCCACCTGGAGACGGTGATTTTGGGCCTATTGAAGACACCTGCTCAGTATGACGCTTCT
GAGCTAAAAGCTTCCATGAAGGGGCTGGGAACCGACGAGGACTCTCTCATTGAGATCATCTGCTCCAGAACCAACCA
GGAGCTGCAGGAAATTAACAGAGTCTACAAGGAAATGTACAAGACTGATCTGGAGAAGGACATTATTTCGGACACAT
CTGGTGACTTCCGCAAGCTGATGGTTGCCCTGGCAAAGGGTAGAAGAGCAGAGGATGGCTCTGTCATTGATTATGAA
CTGATTGACCAAGATGCTCGGGATCTCTATGACGCTGGAGTGAAGAGGAAAGGAACTGATGTTCCCAAGTGGATCAG
CATCATGACCGAGCGGAGCGTGCCCCACCTCCAGAAAGTATTTGATAGGTACAAGAGTTACAGCCCTTATGACATGT
TGGAAAGCATCAGGAAAGAGGTTAAAGGAGACCTGGAAAATGCTTTCCTGAACCTGGTTCAGTGCATTCAGAACAAG
CCCCTGTATTTTGCTGATCGGCTGTATGACTCCATGAAGGGCAAGGGGACGCGAGATAAGGTCCTGATCAGAATCAT
GGTCTCCCGCAGTGAAGTGGACATGTTGAAAATTAGGTCTGAATTCAAGAGAAAGTACGGCAAGTCCCTGTACTATT
ATATCCAGCAAGACACTAAGGGCGACTACCAGAAAGCGCTGCTGTACCTGTGTGGTGGAGATGACTGAAGCCCGACA
CGGCCTGAGCGTCCAGAAATGGTGCTCACCATGCTTCCAGCTAACAGGTCTAGAAAACCAGCTTGCGAATAACAGTC
CCCGTGGCCATCCCTGTGAGGGTGACGTTAGCATTACCCCCAACCTCATTTTAGTTGCCTAAGCATTGCCTGGCCTT
CCTGTCTAGTCTCTCCTGTAAGCCAAAGAAATGAACATTCCAAGGAGTTGGAAGTGAAGTCTATGATGTGAAACACT
TTGCCTCCTGTGTACTGTGTCATAAACAGATGAATAAACTGAATTTGTACTTT

FIGURE 82

GGCGGCGGGAGCAGCGAAGGGGGCGGCAGGGATCCTCCAGGCTGCCGGCTGGGAAGGCGTGGGCGACCCGGTGTGTG
GCGCGCCCAGAGCCCCGCGTTTCAGCCCTAGGGAAGGAAGCCAGTTGAGGGAAGTTCTCCATGAATGTACGTCACAA
TGATGATGACCGACCAAATCCCTCTGGAACTGCCACCATTGCTGAACGGAGAGGTAGCCATGATGCCCCACTTGGTG
AATGGAGATGCAGCTCAGCATGTTATTCTCGTTCAAGTTAATCCAGGTGAGACTTTCACAATAAGAGCAGAGGATGG
AACACTTCAGTGCATTCAAGGACCTGCTGAAGTTCCCATGATGTCACCCAATGGATCCATTCCTCCCATTCATGTGC
CTCCAGGTTATATCTCACAGGTGATTGAAGATAGTACTGGAGTCCGCCGGGTGGTGGTCACACCCCAGTCTCCTGAG
TGTTATCCCCCAAGCTACCCCTCAGCCATGTCTCCAACCCATCATCTCCCTCCCTATCTGACTCACCATCCACATTT
TATTCATAACTCACACACGGCTTACTACCCACCTGTTACCGGACCTGGAGATATGCCGCCTCAGTTTTTTCCCCAGC
ATCATCTTCCCCACACAATATATGGTGAGCAAGAAATTATACCATTTTATGGAATGTCAAGCTACATCACCCGAGAA
GACCAGTACAGCAAGCCTCCGCACAAAAAACTGAAAGACCGCCAGATCGATCGCCAGAACCGCCTCAACAGCCCTCC
TTCTTCTATCTACAAAAGCAGCTGCACAACAGTATACAATGGCTATGGAAGGGCCATAGTGGTGGAAGTGGCGGAG
GCGGCAGCGGTAGTGGTCCCGGAATTAAGAAAACAGAGCGACGAGCAAGAAGCAGCCCAAAGTCGAATGATTCAGAC
TTGCAAGAATATGAGTTGGAAGTAAAGAGGGTGCAAGACATTCTTTCGGGAATAGAGAAACCACAGGTTTCTAATAT
TCAGGCAAGAGCAGTTGTGTTGTCCTGGGCTCCCCCTGTTGGACTTTCCTGTGGACCCCACAGTGGTCTTTCCTTCC
CCTACAGTTACGAGGTGGCCTTATCAGACAAAGGACGAGATGGAAAATACAAGATAATTTACAGTGGAGAAGAATTA
GAATGTAACCTGAAAGATCTTAGACCAGCAACAGATTATCATGTGAGGGTGTATGCCATGTACAATTCCGTAAAGGG
ATCCTGCTCCGAGCCTGTTAGCTTCACCACCCACAGCTGTGCACCCGAGTGTCCTTTCCCCCCTAAGCTGGCACATA
GGAGCAAAAGTTCACTAACCCTGCAGTGGAAGGCACCAATTGACAACGGTTCAAAAATCACCAACTACCTTTTAGAG
TGGGATGAGGGAAAAAGAAATAGTGGTTTCAGACAGTGCTTCTTCGGGAGCCAGAAGCACTGCAAGTTGACAAAGCT
TTGTCCGGCAATGGGGTACACATTCAGGCTGGCCGCTCGAAACGACATTGGCACCAGTGGTTATAGCCAAGAGGTGG
TGTGCTACACATTAGGAAATATCCCTCAGATGCCTTCTGCACTAAGGCTGGTTCGAGCTGGCATCACATGGGTCACG
TTGCAGTGGAGTAAGCCAGAAGGCTGTTCACCCGAGGAAGTGATCACCTACACCTTGGAAATTCAGGAGGATGAAAA
TGATAACCTTTTCCACCCAAAATACACTGGAGAGGATTTAACCTGTACTGTGAAAAATCTCAAAAGAAGCACACAGT
ATAAATTCAGGCTGACTGCTTCTAATACGGAAGGAAAAAGCTGTCCAAGCGAAGTTCTTGTTTGTACGACGAGTCCT
GACAGGCCTGGACCTCCTACCAGACCGCTTGTCAAAGGCCCAGTTACATCTCATGGCTTTAGTGTCAAATGGGATCC
CCCTAAGGACAATGGTGGTTCAGAAATCCTCAAGTACTTGCTAGAGATTACTGATGGAAATTCTGAAGCGAATCAGT
GGGAAGTGGCCTACAGTGGGTCGGCTACCGAATACACCTTCACCCACTTGAAACCAGGCACTTTGTACAAACTCCGA
GCATGCTGCATCAGTACCGGCGGACACAGCCAGTGTTCTGAAAGTCTCCCTGTTCGCACACTAAGCATTGCACCAGG
TCAATGTCGACCACCGAGGGTTTTGGGTAGACCAAAGCACAAAGAAGTCCACTTAGAGTGGGATGTTCCTGCATCGG
AAAGTGGCTGTGAGGTCTCAGAGTACAGCGTGGAGATGACGGAGCCCGAAGACGTAGCCTCGGAAGTGTACCATGGC
CCAGAGCTGGAGTGCACCGTCGGCAACCTGCTTCCTGGAACCGTGTATCGCTTCCGGGTGAGGGCTCTGAATGATGG
AGGGTATGGTCCCTATTCTGATGTCTCAGAAATTACCACTGCTGCAGGGCCTCCTGGACAATGCAAAGCACCTTGTA
TTTCTTGTACACCTGATGGATGTGTCTTAGTGGGTTGGGAGAGTCCTGATAGTTCTGGTGCTGACATCTCAGAGTAC
AGGTTGGAATGGGGAGAAGATGAAGAATCCTTAGAACTCATTTATCATGGGACAGACACCCGTTTTGAAATAAGAGA
CCTGTTGCCTGCTGCACAGTATTGCTGTAGACTACAGGCCTTCAATCAAGCAGGGGCAGGGCCGTACAGTGAACTTG
TCCTTTGCCAGACGCCAGCGTCTGCCCCTGACCCCGTCTCCACTCTCTGTGTCCTGGAGGAGGAGCCCCTTGATGCC
TACCCTGATTCACCTTCTGCGTGCCTTGTACTGAACTGGGAAGAGCCGTGCAATAACGGATCTGAAATCCTTGCTTA
CACCATTGATCTAGGAGACACTAGCATTACCGTGGGCAACACCACCATGCATGTTATGAAAGATCTCCTTCCAGAAA
CCACCTACCGGATCAGAATTCAGGCTATAAATGAAATTGGAGCTGGACCATTTAGTCAGTTCATTAAAGCAAAAACT
CGGCCATTACCACCCTTGCCTCCTAGGCTAGAATGTGCTGCTGCTGGTCCTCAGAGCCTGAAGCTAAAATGGGGAGA
CAGTAACTCCAAGACACATGCTGCTGAGGACATTGTGTACACACTACAGCTGGAGGACAGAAACAAGAGGTTTATTT
CAATCTACAGAGGACCCAGCCACACCTACAAGGTCCAGAGACTGACGGAATTCACATGCTACTCCTTCAGAATCCAG
GCAGCAAGCGAGGCTGGAGAAGGGCCCTTCTCAGAAACCTATACCTTCAGCACAACCAAAAGTGTCCCCCCCACCAT
CAAAGCACCTCGAGTAACACAGTTAGAAGTAAATTCATGTGAAATTTTATGGGAGACGGTACCATCAATGAAAGGTG
ACCCTGTTAACTACATTCTGCAGGTATTGGTTGGAAGAGAATCTGAGTACAAACAGGTGTACAAGGGAGAAGAAGCC
ACATTCCAAATCTCAGGCCTCCAGACCAACACAGACTACAGGTTCCGCGTATGTGCGTGTCGTCGCTGTTTAGACAC
CTCTCAGGAGCTAAGCGGAGCCTTCAGCCCCTCTGCGGCTTTTGTATTACAACGAAGTGAGGTCATGCTTACAGGGG
ACATGGGAGCTTAGATGATCCCAAAATGAAGAGCATGATGCCTACTGATGAACAGTTTGCAGCCATCATTGTGCTT
GGCTTTGCAACTTTGTCCATTTTATTTGCCTTTATATTACAGTACTTCTTAATGAAGTAAACCCAACAAAACTAGAG
GTATGAATTAATGCTACACATTTTAATACACACATTTATTCAGATACTCCCCTTTTTAAAGCCCTTTTGTTTTTTGA
TTTATATACTCTGTTTTACAGATTTAGCTAGAAAAAAAATGTCAGTGTTTTGGTGCACCTTTTTGAAATGCAAAACT
AGGAAAAGGTTAAACTGGATTTTTTTTAAAAAAAAAAAAAAAAAAAAAA

FIGURE 83

GCGGGCGCGGGCGGGACGGGCGCCCCGCGGCCGGACCCAGCCAGGGCACCACGCTGCCCGGCCCTGCGCCGCCAGGC
ACTTCTTTCCGGGGCTCCTAGGGACGCCAGAAGGAAGTCAACCTCTGCTGCTTCTCCTTGGCCTGCGTTGGACCTTC
CTTTTTTTGTTGTTTTTTTTTGTTTTTCCCCTTTCTTCCTTTTGAATTAACTGGCTTCTTGGCTGGATGTTTTCAAC
TTCTTTCCTGGCTGCGAACTTTTCCCCAATTGTTTTCCTTTTACAACAGGGGGAGAAAGTGCTCTGTGGTCCGAGGC
GAGCCGTGAAGTTGCGTGTGCGTGGCAGTGTGCGTGGCAGGATGTGCGTGCGTGTGTAACCCGAGCCGCCCGATCTG
TTTCGATCTGCGCCGCGGAGCCCTCCCTCAAGGCCCGCTCCACCTGCTGCGGTTACGCGGCGCTCGTGGGTGTTCGT
GCCTCGGAGCAGCTAACCGGCGGGTGCTGGGCGACGGTGGAGGAGTATCGTCTCGCTGCTGCCCGAGTCAGGGCTGA
GTCACCCAGCTGATGTAGACAGTGGCTGCCTTCCGAAGAGTGCGTGTTTGCATGTGTGTGACTCTGCGGCTGCTCAA
CTCCCAACAAACCAGAGGACCAGCCACAAACTTAACCAACATCCCCAAACCCGAGTTCACAGATGTGGGAGAGCTGT
AGAACCCTGAGTGTCATCGACTGGGCCTTCTTATGATTGTTGTTTTAAGATTAGCTGAAGATCTCTGAAACGCTGAA
TTTTCTGCACTGAGCGTTTTGACAGAATTCATTGAGAGAACAGAGAACATGACAAGTACTTCTAGCTCAGCACTGCT
CCAACTACTGAAGCTGATTTTCAAGGCTACTTAAAAAAATCTGCAGCGTACATTAATGGATTTCTGTTGTGTTTAAA
TTCTCCACAGATTGTATTGTAAATATTTTATGAAGTAGAGCATATGTATATATTTATATATACGTGCACATACATTA
GTAGCACTACCTTTGGAAGTCTCAGCTCTTGCTTTTCGGGACTGAAGCCAGTTTTGCATGATAAAAGTGGCCTTGTT
ACGGGAGATAATTGTGTTCTGTTGGGACTTTAGACAAAACTCACCTGCAAAAAACTGACAGGCATTAACTACTGGAA
CTTCCAAATAATGTGTTTGCTGATCGTTTTACTCTTCGCATAAATATTTTAGGAAGTGTATGAGAATTTTGCCTTCA
GGAACTTTTCTAACAGCCAAAGACAGAACTTAACCTCTGCAAGCAAGATTCGTGGAAGATAGTCTCCACTTTTTAAT
GCACTAAGCAATCGGTTGCTAGGAGCCCATCCTGGGTCAGAGGCCGATCCGCAGAACCAGAACGTTTTCCCCTCCTG
GACTGTTAGTAACTTAGTCTCCCTCCTCCCCTAACCACCCCCGCCCCCCCCACCCCCCGCAGTAATAAAGGCCCCT
GAACGTGTATGTTGGTCTCCCGGGAGCTGCTTGCTGAAGATCCGCGCCCCTGTCGCCGTCTGGTAGGAGCTGTTTGC
AGGGTCCTAACTCAATCGGCTTGTTGTGATGCGTATCCCCGTAGATGCCAGCACGAGCCGCCGCTTCACGCCGCCTT
CCACCGCGCTGAGCCCAGGCAAGATGAGCGAGGCGTTGCCGCTGGGCGCCCCGGACGCCGGCGCTGCCCTGGCCGGC
AAGCTGAGGAGCGGCGACCGCAGCATGGTGGAGGTGCTGGCCGACCACCCGGGCGAGCTGGTGCGCACCGACAGCCC
CAACTTCCTCTGCTCCGTGCTGCCTACGCACTGGCGCTGCAACAAGACCCTGCCCATCGCTTTCAAGGTGGTGGCCC
TAGGGGATGTTCCAGATGGCACTCTGGTCACTGTGATGGCTGGCAATGATGAAAACTACTCGGCTGAGCTGAGAAAT
GCTACCGCAGCCATGAAGAACCAGGTTGCAAGATTTAATGACCTCAGGTTTGTCGGTCGAAGTGGAAGAGGGAAAAG
CTTCACTCTGACCATCACTGTCTTCACAAACCCACCGCAAGTCGCCACCTACCACAGAGCCATCAAAATCACAGTGG
ATGGGCCCCGAGAACCTCGAAGACATCGGCAGAAACTAGATGATCAGACCAAGCCCGGGAGCTTGTCCTTTTCCGAG
CGGCTCAGTGAACTGGAGCAGCTGCGGCGCACAGCCATGAGGGTCAGCCCACACCACCCAGCCCCCACGCCCAACCC
TCGTGCCTCCCTGAACCACTCCACTGCCTTTAACCCTCAGCCTCAGAGTCAGATGCAGGATACAAGGCAGATCCAAC
CATCCCCACCGTGGTCCTACGATCAGTCCTACCAATACCTGGGATCCATTGCCTCTCCTTCTGTGCACCCAGCAACG
CCCATTTCACCTGGACGTGCCAGCGGCATGACAACCCTCTCTGCAGAACTTTCCAGTCGACTCTCAACGGCACCCGA
CCTGACAGCGTTCAGCGACCCGCGCCAGTTCCCCGCGCTGCCCTCCATCTCCGACCCCCGCATGCACTATCCAGGCG
CCTTCACCTACTCCCCGACGCCGGTCACCTCGGGCATCGGCATCGGCATGTCGGCCATGGGCTCGGCCACGCGCTAC
CACACCTACCTGCCGCCGCCCTACCCCGGTTCGTCGCAAGCGCAGGGAGGCCCGTTCCAAGCCAGCTCGCCCTCCTA
CCACCTGTACTACGGCGCCTCGGCCGGCTCCTACCAGTTCTCCATGGTGGGCGGGGAGCGCTCGCCGCCGCGCATCC
TGCCGCCCTGCACCAACGCCTCCACCGGCTCCGCGCTGCTCAACCCCAGCCTCCCGAACCAGAGCGACGTGGTGGAG
GCCGAGGGCAGACACAGAAACTCCCCCACCAACATGGGGGGGCCTCCTGTTCGCGACAAGCCCGCCGGGATCCCGG
GCCCTGGGCCCGGACACCGTCCTGGGGCCGAGGGCGCCCGACGGACAGGATCTCGCTGTAGGTCAGGCCCGCGCAGC
CTCCTGCGCCCAGAAGCCCACGCCGCCGCCGTCTGCTGGCGCCCCGGCCCTCGCGGAGGTGTCCGAGGCGACGCACC
TCGAGGGTGTCCGCCGGCCCCAGCACCCAGGGGACGCGCTGGAAAGCAAACAGGAAGATTCCCGGAGGGAAACTGTG
AATGCTTCTGATTTAGCAATGCTGTGAATAAAAAGAAAGATTTTATACCCTTGAGAAAAAAAAAAAAA

FIGURE 84

ACAGAAGTGCTAGAAGCCAGTGCTCGTGAACTAAGGAGAAAAAGAACAGACAAGGGAACAGCCTGGACATGGCATCA
GAGATCCACATGACAGGCCCAATGTGCCTCATTGAGAACACTAATGGGCGACTGATGGCGAATCCAGAAGCTCTGAA
GATCCTTTCTGCCATTACACAGCCTATGGTGGTGGTGGCAATTGTGGGCCTCTACCGCACAGGCAAATCCTACCTGA
TGAACAAGCTGGCTGGAAAGAAAAAGGGCTTCTCTCTGGGCTCCACGGTGCAGTCTCACACTAAAGGAATCTGGATG
TGGTGTGTGCCCCACCCCAAGAAGCCAGGCCACATCCTAGTTCTGCTGGACACCGAGGGTCTGGGAGATGTAGAGAA
GGGTGACAACCAGAATGACTCCTGGATCTTCGCCCTGGCCGTCCTCCTGAGCAGCACCTTCGTGTACAATAGCATAG
GAACCATCAACCAGCAGGCTATGGACCAACTGTACTATGTGACAGAGCTGACACATAGAATCCGATCAAAATCCTCA
CCTGATGAGAATGAGAATGAGGTTGAGGATTCAGCTGACTTTGTGAGCTTCTTCCCAGACTTTGTGTGGACACTGAG
AGATTTCTCCCTGGACTTGGAAGCAGATGGACAACCCCTCACACCAGATGAGTACCTGACATACTCCCTGAAGCTGA
AGAAAGGTACCAGTCAAAAAGATGAAACTTTTAACCTGCCCAGACTCTGTATCCGGAAATTCTTCCCAAAGAAAAAA
TGCTTTGTCTTTGATCGGCCCGTTCACCGCAGGAAGCTTGCCCAGCTCGAGAAACTACAAGATGAAGAGCTGGACCC
CGAATTTGTGCAACAAGTAGCAGACTTCTGTTCCTACATCTTTAGTAATTCCAAAACTAAAACTCTTTCAGGAGGCA
TCCAGGTCAACGGGCCTCGTCTAGAGAGCCTGGTGCTGACCTACGTCAATGCCATCAGCAGTGGGGATCTGCCGTGC
ATGGAGAACGCAGTCCTGGCCTTGGCCCAGATAGAGAACTCAGCTGCAGTGCAAAAGGCTATTGCCCACTATGAACA
GCAGATGGGCCAGAAGGTGCAGCTGCCCACAGAAAGCCTCCAGGAGCTGCTGGACCTGCACAGGGACAGTGAGAGAG
AGGCCATTGAAGTCTTCATCAGGAGTTCCTTCAAAGATGTGGACCATCTATTTCAAAAGGAGTTAGCGGCCCAGCTA
GAAAAAAAGCGGGATGACTTTTGTAAACAGAATCAGGAAGCATCATCAGATCGTTGCTCAGGTTTACTTCAGGTCAT
TTTCAGTCCTCTAGAAGAAGAAGTGAAGGCGGGAATTTATTCGAAACCAGGGGGCTATCGTCTCTTTGTTCAGAAGC
TACAAGACCTGAAGAAAAAGTACTATGAGGAACCGAGGAAGGGGATACAGGCTGAAGAGATTCTGCAGACATACTTG
AAATCCAAGGAGTCTATGACTGATGCAATTCTCCAGACAGACCAGACTCTCACAGAAAAAGAAAAGGAGATTGAAGT
GGAACGTGTGAAAGCTGAGTCTGCACAGGCTTCAGCAAAAATGTTGCAGGAAATGCAAAGAAAGAATGAGCAGATGA
TGGAACAGAAGGAGAGGAGTTATCAGGAACACTTGAAACAACTGACTGAGAAGATGGAGAACGACAGGGTCCAGTTG
CTGAAAGAGCAAGAGAGGACCCTCGCTCTTAAACTTCAGGAACAGGAGCAACTACTAAAAGAGGGATTTCAAAAAGA
AAGCAGAATAATGAAAAATGAGATACAGGATCTCCAGACGAAAATGAGACGACGAAAGGCATGTACCATAAGCTAAA
GACCAGAGCCTTCCTGTCACCCCTAACCAAGGCATAATTGAAACAATTTTAGAATTTGGAACAAGCGTCACTACATT
TGATAATAATTAGATCTTGCATCATAACACCAAAAGTTTATAAAGGCATGTGGTACAATGATCAAAATCATGTTTTT
TCTTAAAAAAAAAAAAAAGACTGTAAATTGTGCAACAAAGATGCATTTACCTCTGTATCAACTCAGGAAATCTCATA
AGCTGGTACCACTCAGGAGAAGTTTATTCTTCCAGATGACCAGCAGTAGACAAATGGATACTGAGCAGAGTCTTAGG
TAAAAGTCTTGGGAAATATTTGGGCATTGGTCTGGCCAAGTCTACAATGTCCCAATATCAAGGACAACCACCCTAGC
TTCTTAGTGAAGACAATGTACAGTTATCCATTAGATCAAGACTACACGGTCTATGAGCAATAATGTGATTTCTGGAC
ATTGCCCATGTATAATCCTCACTGATGATTTCAAGCTAAAGCAAACCACCTTATACAGAGATCTAGAATCTCTTTAT
GTTCTCCAGAGGAAGGTGGAAGAAACCATGGGCAGGAGTAGGAATTGAGTGATAAACAATTGGGCTAATGAAGAAAA
CTTCTCTTATTGTTCAGTTCATCCAGATTATAACTTCAATGGGACACTTTAGACCATTAGACAATTGACACTGGATT
AAACAAATTCACATAATGCCAAATACACAATGTATTTATAGCAACGTATAATTTGCAAAGATGGACTTTAAAAGATG
CTGTGTAACTAAACTGAAATAATTCAATTACTTATTATTTAGAATGTTAAAGCTTATGATAGTCTTTTCTAATTCTT
AACACTCATACTTGAAATCTTTCCGAGTTTCCCCAGAAGAGAATATGGGATTTTTTTTGACATTTTTGACCCATTTA
ATAATGCTCTTGTGTTTACCTAGTATATGTAGACTTTGTCTTATGTGTCAAAAGTCCTAGGAAAGTGGTTGATGTTT
CTTATAGCAATTAAAAATTATTTTTGAACTGA

FIGURE 85

CTCTGTTTTCTCAAAGCTGAAGTCGGCTAGGTTTGCAAAGCTGTGGGCTGAGCACTCAGGCAATCACACTCTCAGAA
ACTGCGGCGGCTCTGGACTGCAGCCTCCCAAGGCTCCATGCCAGACAAAGCATGCGTGTCACACTTGCTACAATAGC
CTGGATGGTTTCTTTTGTCTCCAATTATTCACACACAGCAAATATTTTGCCAGATATCGAAAATGAAGATTTCATCA
AAGACTGCGTTCGAATCCATAACAAGTTCCGATCAGAGGTGAAACCAACAGCCAGTGATATGCTATACATGACTTGG
GACCCAGCACTAGCCCAAATTGCAAAAGCATGGGCCAGCAATTGCCAGTTTTCACATAATACACGGCTGAAGCCACC
CCACAAGCTGCACCCAAACTTCACTTCACTGGGAGAGAACATCTGGACTGGGTCTGTGCCCATTTTTTCTGTGTCTT
CCGCCATCACAAACTGGTATGACGAAATCCAGGACTATGACTTCAAGACTCGGATATGCAAAAAAGTCTGTGGCCAC
TACACTCAGGTTGTTTGGGCAGATAGTTACAAAGTTGGCTGCGCAGTTCAATTTTGCCCTAAAGTTTCTGGCTTTGA
CGCTCTTTCCAATGGAGCACATTTTATATGCAACTACGGACCAGGAGGGAATTACCCAACTTGGCCATATAAGAGAG
GAGCCACCTGCAGTGCCTGCCCCAATAATGACAAGTGTTTGGACAATCTCTGTGTTAACCGACAGCGAGACCAAGTG
AAACGTTACTACTCTGTTGTATATCCAGGCTGGCCCATATATCCACGTAACAGATACACTTCTCTCTTTCTCATTGT
TAATTCAGTAATTCTAATACTGTCTGTTATAATTACCATTTTGGTACAGCTCAAGTACCCTAATTTAGTTCTTTTGG
ACTAATACAATTCAGGAAAGAAAAAACCCAAAAACCAACCTCATTCACATATGGCTTTTTTTTAACCAATAACAATT
AGGTGTACTTCTATTTTAAAACATTTCAGAAAAAAATATATGTTATAGCAATACTCTTAC

FIGURE 86

TCCAATTCAAAAAGAAAGTCTCTGACGTTAGTTAGTTTAATTTAACATCTTTTTATGTGTAACACTTGACTTTGGAA
GCAAAAATGAACTTTGCGGAGAGAGAGGGCTCTAAGAGATACTGCATTCAAACGAAACATGTGGCCATTCTCTGTGC
GGTGGTGGTGGGTGTAGGATTAATAGTGGGACTTGCCGTGGGCTTGACCAGATCGTGTGACTCCAGCGGGGACGGCG
GGCCGGGCACTGCGCCAGCTCCTTCCCACCTGCCTTCTTCCACGGCCAGCCCCTCAGGTCCTCCTGCCCAGGACCAG
GACATCTGCCCGGCCAGTGAGGATGAGAGCGGACAGTGGAAAAACTTTCGACTGCCGGACTTCGTCAACCCAGTCCA
CTACGACCTGCACGTGAAGCCCCTGTTGGAGGAGGACACCTACACGGGCACCGTGAGCATCTCCATCAACCTGAGCG
CTCCCACCCGGTACCTGTGGCTGCACCTCCGGGAGACCAGGATCACCCGGCTCCCGGAGCTGAAGAGGCCCTCTGGG
GACCAGGTGCAAGTCCGGAGGTGTTTCGAGTACAAAAAGCAGGAGTACGTGGTGGTCGAGGCGGAGGAAGAGCTTAC
CCCCAGCAGTGGAGATGGCCTGTATCTCCTGACCATGGAGTTCGCCGGCTGGCTGAACGGCTCCCTCGTGGGATTTT
ATAGAACCACCTACACGGAGAACGGACGAGTCAAGAGCATAGCGGCCACCGATCATGAACCAACAGATGCCAGGAAA
TCTTTTCCTTGTTTTGATGAGCCCAACAAAAAGGCAACTTATACAATATCTATCACCCATCCCAAAGAATACGGAGC
ACTTTCAAATATGCCAGTGGCGAAAGAAGAGTCAGTGGATGATAAATGGACTCGAACAACTTTTGAGAAGTCTGTCC
CCATGAGCACGTACCTGGTGTGCTTTGCTGTACATCAATTTGACTCTGTAAAGAGAATATCAAATAGTGGAAAACCT
CTTACAATTTATGTCCAGCCAGAGCAAAAGCACACAGCCGAATATGCTGCAAACATAACTAAAAGTGTGTTTGATTA
TTTTGAAGAATACTTTGCTATGAATTATTCTCTTCCTAAATTAGATAAAATCGCTATTCCAGATTTTGGCACTGGTG
CCATGGAGAACTGGGGACTCATCACGTACAGAGAAACGAACCTGCTTTATGACCCTAAGGAATCAGCCTCATCAAAC
CAACAGAGGGTGGCCACTGTGGTTGCCCATGAACTTGTGCATCAGTGGTTTGGAAATATTGTGACCATGGACTGGTG
GGAAGACTTGTGGCTAAATGAAGGATTTGCTTCTTTCTTTGAGTTTCTGGGAGTAAACCATGCAGAAACAGACTGGC
AAATGCGTGACCAAATGTTACTTGAAGATGTATTACCTGTTCAAGAGGATGATTCTTTGATGTCTTCGCATCCAATT
ATTGTGACTGTGACAACCCCTGATGAAATAACATCTGTTTTTGATGGAATATCCTATAGCAAGGGATCTTCTATTTT
GAGAATGCTTGAAGACTGGATAAAACCAGAGAATTTTCAAAAAGGATGTCAGATGTACTTGGAAAAATACCAATTCA
AGAATGCAAAAACTTCTGATTTTTGGGCAGCACTGGAAGAGGCAAGTAGGCTACCAGTGAAAGAAGTAATGGACACC
TGGACCAGACAGATGGGTTATCCTGTGCTTAACGTGAACGGTGTCAAGAACATCACACAGAAACGCTTTTTGTTGGA
CCCAAGAGCTAACCCTTCTCAGCCCCCTTCAGATCTTGGTTATACATGGAATATCCCAGTTAAATGGACTGAAGATA
ATATAACAAGCAGTGTGTTATTTAATAGGTCAGAAAAAGAAGGAATCACTTTGAACTCCTCTAATCCTAGTGGAAAT
GCTTTTCTCAAAATAAACCCAGATCATATTGGGTTTTATCGTGTAAATTATGAAGTAGCAACTTGGGACTCGATAGC
TACAGCGCTCTCCTTGAACCACAAGACATTTTCTTCAGCAGATCGTGCAAGTCTTATTGATGATGCTTTTGCCTTGG
CAAGAGCTCAACTTCTAGATTATAAGGTGGCTTTGAACTTGACCAAGTATCTCAAAAGGGAAGAGAATTTTTTACCA
TGGCAGAGAGTAATTTCAGCTGTAACCTACATCATTAGCATGTTTGAAGATGATAAAGAGCTATATCCTATGATTGA
GGAATACTTCCAAGGTCAAGTGAAGCCTATTGCAGATTCTCTGGGATGGAATGATGCTGGAGACCATGTCACAAAGT
TACTCCGTTCCTCCGTGTTAGGGTTTGCGTGCAAGATGGGAGACAGAGAAGCCTTGAACAATGCTTCCTCGTTATTT
GAGCAGTGGCTAAATGGGACTGTAAGCCTTCCCGTAAATCTCAGGCTTCTGGTGTATCGGTATGGGATGCAGAACTC
TGGCAATGAGATTTCATGGAACTACACTCTTGAGCAATACCAGAAAACTTCATTAGCTCAAGAAAAAGAAAAACTGC
TGTATGGATTAGCATCAGTGAAGAACGTTACTCTTTTGTCAAGGTATTTGGATTTGCTCAAGGACACGAACCTTATT
AAAACTCAGGATGTGTTTACAGTCATTCGATATATCTCATATAACAGCTATGGGAAGAACATGGCCTGGAATTGGAT
ACAACTCAACTGGGACTATCTAGTCAACAGATATACACTCAATAACAGAAACCTTGGCCGAATTGTCACAATAGCAG
AGCCATTCAACACTGAACTGCAACTGTGGCAGATGGAGAGCTTTTTTGCAAAATATCCACAAGCTGGAGCAGGAGAA
AAACCTAGGGAACAAGTGCTGGAAACAGTGAAAAACAATATAGAGTGGCTAAAACAACATAGAAACACCATCAGAGA
ATGGTTTTTTAATTTACTTGAGAGTGGTTAATGTATTCAAATGTTAGAGTTTAATTTTGTGAATCTATTGTTTC

FIGURE 87

GGGCAAGGCTGGGCCGGGAAGGGCGTGGGTTGAGGAGAGGCTCCAGACCCGCACGCCGCGCGCACAGAGCTCTCAGC
GCCGCTCCCAGCCACAGCCTCCCGCGCCTCGCTCAGCTCCAACATGGCAAAAATCTCCAGCCCTACAGAGACTGAGC
GGTGCATCGAGTCCCTGATTGCTGTCTTCCAGAAGTATGCTGGAAAGGATGGTTATAACTACACTCTCTCCAAGACA
GAGTTCCTAAGCTTCATGAATACAGAACTAGCTGCCTTCACAAAGAACCAGAAGGACCCTGGTGTCCTTGACCGCAT
GATGAAGAAACTGGACACCAACAGTGATGGTCAGCTAGATTTCTCAGAATTTCTTAATCTGATTGGTGGCCTAGCTA
TGGCTTGCCATGACTCCTTCCTCAAGGCTGTCCCTTCCCAGAAGCGGACCTGAGGACCCCTTGGCCCTGGCCTTCAA
ACCCACCCCCTTTCCTTCCAGCCTTTCTGTCATCATCTCCACAGCCCACCCATCCCCTGAGCACACTAACCACCTCA
TGCAGGCCCCACCTGCCAATAGTAATAAAGCAATGTCACTTTTTTAAAACATGAAA

FIGURE 88A

GCGATCCGGGCGCCACCCCGCGGTCATCGGTCACCGGTCGCTCTCAGGAACAGCAGCGCAACCTCTGCTCCCTGCCT
CGCCTCCCGCGCGCCTAGGTGCCTGCGACTTTAATTAAAGGGCCGTCCCCTCGCCGAGGCTGCAGCACCGCCCCCCC
GGCTTCTCGCGCCTCAAA<u>ATG</u>AGTAGCTCCCACTCTCGGGCGGGCCAGAGCGCAGCAGGCGCGGCTCCGGGCGGCGG
CGTCGACACGCGGGACGCCGAGATGCCGGCCACCGAGAAGGACCTGGCGGAGGACGCGCCGTGGAAGAAGATCCAGC
AGAACACTTTCACGCGCTGGTGCAACGAGCACCTGAAGTGCGTGAGCAAGCGCATCGCCAACCTGCAGACGGACCTG
AGCGACGGGCTGCGGCTTATCGCGCTGTTGGAGGTGCTCAGCCAGAAGAAGATGCACCGCAAGCACAACCAGCGGCC
CACTTTCCGCCAAATGCAGCTTGAGAACGTGTCGGTGGCGCTCGAGTTCCTGGACCGCGAGAGCATCAAACTGGTGT
CCATCGACAGCAAGGCCATCGTGGACGGGAACCTGAAGCTGATCCTGGGCCTCATCTGGACCCTGATCCTGCACTAC
TCCATCTCCATGCCCATGTGGGACGAGGAGGAGGATGAGGAGGCCAAGAAGCAGACCCCCAAGCAGAGGCTCCTGGG
CTGGATCCAGAACAAGCTGCCGCAGCTGCCCATCACCAACTTCAGCCGGGACTGGCAGAGCGGCCGGGCCCTGGGCG
CCCTGGTGGACAGCTGTGCCCCGGGCCTGTGTCCTGACTGGGACTCTTGGGACGCCAGCAAGCCCGTTACCAATGCG
CGAGAGGCCATGCAGCAGGCGGATGACTGGCTGGGCATCCCCCAGGTGATCACCCCCGAGGAGATTGTGGACCCCAA
CGTGGACGAGCACTCTGTCATGACCTACCTGTCCCAGTTCCCCAAGGCCAAGCTGAAGCCAGGGGCTCCCTTGCGCC
CCAAACTGAACCCGAAGAAAGCCCGTGCCTACGGGCCAGGCATCGAGCCCACAGGCAACATGGTGAAGAAGCGGGCA
GAGTTCACTGTGGAGACCAGAAGTGCTGGCCAGGGAGAGGTGCTGGTGTACGTGGAGGACCCGGCCGGACACCAGGA
GGAGGCAAAAGTGACCGCCAATAACGACAAGAACCGCACCTTCTCCGTCTGGTACGTCCCCGAGGTGACGGGGACTC
ATAAGGTTACTGTGCTCTTTGCTGGCCAGCACATCGCCAAGAGCCCCTTCGAGGTGTACGTGGATAAGTCACAGGGT
GACGCCAGCAAAGTGACAGCCCAAGGTCCCGGCCTGGAGCCCAGTGGCAACATCGCCAACAAGACCACCTACTTTGA
GATCTTTACGGCAGGAGCTGGCACGGGCGAGGTCGAGGTTGTGATCCAGGACCCCATGGGACAGAAGGGCACGGTAG
AGCCTCAGCTGGAGGCCCGGGGCGACAGCACATACCGCTGCAGCTACCAGCCCACCATGGAGGGCGTCCACACCGTG
CACGTCACGTTTGCCGGCGTGCCCATCCCTCGCAGCCCCTACACTGTCACTGTTGGCCAAGCCTGTAACCCGAGTGC
CTGCCGGGCGGTTGGCCGGGGCCTCCAGCCCAAGGGTGTGCGGGTGAAGGAGACAGCTGACTTCAAGGTGTACACAA
AGGGCGCTGGCAGTGGGGAGCTGAAGGTCACCGTGAAGGGCCCCAAGGGAGAGGAGCGCGTGAAGCAGAAGGACCTG
GGGGATGGCGTGTATGGCTTCGAGTATTACCCCATGGTCCCTGGAACCTATATCGTCACCATCACGTGGGGTGGTCA
GAACATCGGGCGCAGTCCCTTCGAAGTGAAGGTGGGCACCGAGTGTGGCAATCAGAAGGTACGGGCCTGGGGCCCTG
GGCTGGAGGGCGGCGTCGTTGGCAAGTCAGCAGACTTTGTGGTGGAGGCTATCGGGGACGACGTGGGCACGCTGGGC
TTCTCGGTGGAAGGGCCATCGCAGGCTAAGATCGAATGTGACGACAAGGGCGACGGCTCCTGTGATGTGCGCTACTG
GCCGCAGGAGGCTGGCGAGTATGCCGTTCACGTGCTGTGCAACAGCGAAGACATCCGCCTCAGCCCCTTCATGGCTG
ACATCCGTGACGCGCCCCAGGACTTCCACCCAGACAGGGTGAAGGCACGTGGGCCTGGATTGGAGAAGACAGGTGTG
GCCGTCAACAAGCCAGCAGAGTTCACAGTGGATGCCAAGCACGGTGGCAAGGCCCCACTTCGGGTCCAAGTCCAGGA
CAATGAAGGCTGCCCTGTGGAGGCGTTGGTCAAGGACAACGGCAATGGCACTTACAGCTGCTCCTACGTGCCCAGGA
AGCCGGTGAAGCACACAGCCATGGTGTCCTGGGGAGGCGTCAGCATCCCCAACAGCCCCTTCAGGGTGAATGTGGGA
GCTGGCAGCCACCCCAACAAGGTCAAAGTATACGGCCCCGGAGTAGCCAAGACAGGGCTCAAGGCCCACGAGCCCAC
CTACTTCACTGTGGACTGCGCCGAGGCTGGCCAGGGGGACGTCAGCATCGGCATCAAGTGTGCCCCTGGAGTGGTAG
GCCCCGCCGAAGCTGACATCGACTTCGACATCATCCGCAATGACAATGACACCTTCACGGTCAAGTACACGCCCCGG
GGGGCTGGCAGCTACACCATTATGGTCCTCTTTGCTGACCAGGCCACGCCCACCAGCCCCATCCGAGTCAAGGTGGA
GCCCTCTCATGACGCCAGTAAGGTGAAGGCCGAGGGCCCTGGCCTCAGTCGCACTGGTGTCGAGCTTGGCAAGCCCA
CCCACTTCACAGTAAATGCCAAAGCTGCTGGCAAAGGCAAGCTGGACGTCCAGTTCTCAGGACTCACCAAGGGGGAT
GCAGTGCGAGATGTGGACATCATCGACCACCATGACAACACCTACACAGTCAAGTACACGCCTGTCCAGCAGGGTCC
AGTAGGCGTCAATGTCACTTATGGAGGGGATCCCATCCCTAAGAGCCCTTTCTCAGTGGCAGTATCTCCAAGCCTGG
ACCTCAGCAAGATCAAGGTGTCTGGCCTGGGAGAGAAGGTGGACGTTGGCAAAGACCAGGAGTTCACAGTCAAATCA
AAGGGTGCTGGTGGTCAAGGCAAAGTGGCATCCAAGATTGTGGGCCCCTCGGGTGCAGCGGTGCCCTGCAAGGTGGA
GCCAGGCCTGGGGGCTGACAACAGTGTGGTGCGCTTCCTGCCCCGTGAGGAAGGGCCCTATGAGGTGGAGGTGACCT
ATGACGGCGTGCCCGTGCCTGGCAGCCCCTTTCCTCTGGAAGCTGTGGCCCCCACCAAGCCTAGCAAGGTGAAGGCG
TTTGGGCCGGGGCTGCAGGGAGGCAGTGCGGGCTCCCCCGCCCGCTTCACCATCGACACCAAGGGCGCCGGCACAGG
TGGCCTGGGCCTGACGGTGGAGGGCCCCTGTGAGGCGCAGCTCGAGTGCTTGGACAATGGGGATGGCACATGTTCCG
TGTCCTACGTGCCCACCGAGCCCGGGGACTACAACATCAACATCCTCTTCGCTGACACCCACATCCCTGGCTCCCCA
TTCAAGGCCCACGTGGTTCCCTGCTTTGACGCATCCAAAGTCAAGTGCTCAGGCCCCGGGCTGGAGCGGGCCACCGC
TGGGGAGGTGGGCCAATTCCAAGTGGACTGCTCGAGCGCGGGCAGCGCGGAGCTGACCATTGAGATCTGCTCGGAGG
CGGGGCTTCCGGCCGAGGTGTACATCCAGGACCACGGTGATGGCACGCACACCATTACCTACATTCCCCTCTGCCCC
GGGGCCTACACCGTCACCATCAAGTACGGCGGCCAGCCCGTGCCCAACTTCCCCAGCAAGCTGCAGGTGGAACCTGC
GGTGGACACTTCCGGTGTCCAGTGCTATGGGCCTGGTATTGAGGGCCAGGGTGTCTTCCGTGAGGCCACCACTGAGT
TCAGTGTGGACGCCCGGGCTCTGACACAGACCGGAGGGCCGCACGTCAAGGCCCGTGTGGCCAACCCCTCAGGCAAC
CTGACGGAGACCTACGTTCAGGACCGTGGCGATGGCATGTACAAAGTGGAGTACACGCCTTACGAGGAGGGACTGCA
CTCCGTGGACGTGACCTATGACGGCAGTCCCGTGCCCAGCAGCCCCTTCCAGGTGCCCGTGACCGAGGGCTGCGACC
CCTCCCGGGTGCGTGTCCACGGGCCAGGCATCCAAAGTGGCACCACCAACAAGCCCAACAAGTTCACTGTGGAGACC
AGGGGAGCTGGCACGGGCGGCCTGGGCCTGGCTGTAGAGGGCCCCTCCGAGGCCAAGATGTCCTGCATGGATAACAA
GGACGGCAGCTGCTCGGTCGAGTACATCCCTTATGAGGCTGGCACCTACAGCCTCAACGTCACCTATGGTGGCCATC
AAGTGCCAGGCAGTCCTTTCAAGGTCCCTGTGCATGATGTGACAGATGCGTCCAAGGTCAAGTGCTCTGGGCCCGGC
CTGAGCCCAGGCATGGTTCGTGCCAACCTCCCTCAGTCCTTCCAGGTGGACACAAGCAAGGCTGGTGTGGCCCCATT
GCAGGTCAAAGTGCAAGGGCCCAAAGGCCTGGTGGAGCCAGTGGACGTGGTAGACAACGCTGATGGCACCCAGACCG
TCAATTATGTGCCCAGCCGAGAAGGGCCCTACAGCATCTCAGTACTGTATGGAGATGAAGAGGTACCCCGGAGCCCC

FIGURE 88B

TTCAAGGTCAAGGTGCTGCCTACTCATGATGCCAGCAAGGTGAAGGCCAGTGGCCCCGGGCTCAACACCACTGGCGT
GCCTGCCAGCCTGCCCGTGGAGTTCACCATCGATGCAAAGGACGCCGGGGAGGGCCTGCTGGCTGTCCAGATCACGG
ATCCCGAAGGCAAGCCGAAGAAGACACACATCCAAGACAACCATGACGGCACGTATACAGTGGCCTACGTGCCAGAC
GTGACAGGTCGCTACACCATCCTCATCAAGTACGGTGGTGACGAGATCCCCTTCTCCCCGTACCGCGTGCGTGCCGT
GCCCACCGGGGACGCCAGCAAGTGCACTGTCACAGTGTCAATCGGAGGTCACGGGCTAGGTGCTGGCATCGGCCCCA
CCATTCAGATTGGGGAGGAGACGGTGATCACTGTGGACACTAAGGCGGCAGGCAAAGGCAAAGTGACGTGCACCGTG
TGCACGCCTGATGGCTCAGAGGTGGATGTGGACGTGGTGGAGAATGAGGACGGCACTTTCGACATCTTCTACACGGC
CCCCCAGCCGGGCAAATACGTCATCTGTGTGCGCTTTGGTGGCGAGCACGTGCCCAACAGCCCCTTCCAAGTGACGG
CTCTGGCTGGGGACCAGCCCTCGGTGCAGCCCCCTCTACGGTCTCAGCAGCTGGCCCCACAGTACACCTACGCCCAG
GGCGGCCAGCAGACTTGGGCCCCGGAGAGGCCCCTGGTGGGTGTCAATGGGCTGGATGTGACCAGCCTGAGGCCCTT
TGACCTTGTCATCCCCTTCACCATCAAGAAGGGCGAGATCACAGGGGAGGTTCGGATGCCCTCAGGCAAGGTGGCGC
AGCCCACCATCACTGACAACAAAGACGGCACCGTGACCGTGCGGTATGCACCCAGCGAGGCTGGCCTGCACGAGATG
GACATCCGCTATGACAACATGCACATCCCAGGAAGCCCCTTGCAGTTCTATGTGGATTACGTCAACTGTGGCCATGT
CACTGCCTATGGGCCTGGCCTCACCCATGGAGTAGTGAACAAGCCTGCCACCTTCACCGTCAACACCAAGGATGCAG
GAGAGGGGGGCCTGTCTCTGGCCATTGAGGGCCCGTCCAAAGCAGAAATCAGCTGCACTGACAACCAGGATGGGACA
TGCAGCGTGTCCTACCTGCCTGTGCTGCCGGGGGACTACAGCATTCTAGTCAAGTACAATGAACAGCACGTCCCAGG
CAGCCCCTTCACTGCTCGGGTCACAGGTGACGACTCCATGCGTATGTCCCACCTAAAGGTCGGCTCTGCTGCCGACA
TCCCCATCAACATCTCAGAGACGGATCTCAGCCTGCTGACGGCCACTGTGGTCCCGCCCTCGGGCCGGGAGGAGCCC
TGTTTGCTGAAGCGGCTGCGTAATGGCCACGTGGGGATTTCATTCGTGCCCAAGGAGACGGGGGAGCACCTGGTGCA
TGTGAAGAAAAATGGCCAGCACGTGGCCAGCAGCCCCATCCCGGTGGTGATCAGCCAGTCGGAAATTGGGGATGCCA
GTCGTGTTCGGGTCTCTGGTCAGGGCCTTCACGAAGGCCACACCTTTGAGCCTGCAGAGTTTATCATTGATACCCGC
GATGCAGGCTATGGTGGGCTCAGCCTGTCCATTGAGGGCCCCAGCAAGGTGGACATCAACACAGAGGACCTGGAGGA
CGGGACGTGCAGGGTCACCTACTGCCCCACAGAGCCAGGCAACTACATCATCAACATCAAGTTTGCCGACCAGCACG
TGCCTGGCAGCCCCTTCTCTGTGAAGGTGACAGGCGAGGGCCGGGTGAAAGAGAGCATCACCCGCAGGCGTCGGGCT
CCTTCAGTGGCCAACGTTGGTAGTCATTGTGACCTCAGCCTGAAAATCCCTGAAATTAGCATCCAGGATATGACAGC
CCAGGTGACCAGCCCATCGGGCAAGACCCATGAGGCCGAGATCGTGGAAGGGGAGAACCACACCTACTGCATCCGCT
TTGTTCCCGCTGAGATGGGCACACACACAGTCAGCGTCAAGTACAAGGGCCAGCACGTGCCTGGGAGCCCCTTCCAG
TTCACCGTGGGGCCCCTAGGGGAAGGGGGAGCCCACAAGGTCCGAGCTGGGGGCCCTGGCCTGGAGAGAGCTGAAGC
TGGAGTGCCAGCCGAATTCAGTATCTGGACCCGGGAAGCTGGTGCTGGAGGCCTGGCCATTGCTGTCGAGGGCCCCA
GCAAGGCTGAGATCTCTTTTGAGGACCGCAAGGACGGCTCCTGTGGTGTGGCTTATGTGGTCCAGGAGCCAGGTGAC
TACGAAGTCTCAGTCAAGTTCAACGAGGAACACATTCCCGACAGCCCCTTCGTGGTGCCTGTGGCTTCTCCGTCTGG
CGACGCCCGCCGCCTCACTGTTTCTAGCCTTCAGGAGTCAGGGCTAAAGGTCAACCAGCCAGCCTCTTTTGCAGTCA
GCCTGAACGGGGCCAAGGGGGCGATCGATGCCAAGGTGCACAGCCCCTCAGGAGCCCTGGAGGAGTGCTATGTCACA
GAAATTGACCAAGATAAGTATGCTGTGCGCTTCATCCCTCGGGAGAATGGCGTTTACCTGATTGACGTCAAGTTCAA
CGGTACCCACATCCCTGGAAGCCCCTTCAAGATCCGAGTTGGGGAGCCTGGGCATGGAGGGGACCCAGGCTTGGTGT
CTGCTTACGGAGCAGGTCTGGAAGGCGGTGTCACAGGGAACCCAGCTGAGTTCGTCGTGAACACGAGCAATGCGGGA
GCTGGTGCCCTGTCGGTGACCATTGACGGCCCCTCCAAGGTGAAGATGGATTGCCAGGAGTGCCCTGAGGGCTACCG
CGTCACCTATACCCCCATGGCACCTGGCAGCTACCTCATCTCCATCAAGTACGGCGGCCCCTACCACATTGGGGGCA
GCCCCTTCAAGGCCAAAGTCACAGGCCCCCGTCTCGTCAGCAACCACAGCCTCCACGAGACATCATCAGTGTTTGTA
GACTCTCTGACCAAGGCCACCTGTGCCCCCCAGCATGGGGCCCCGGGTCCTGGGCCTGCTGACGCCAGCAAGGTGGT
GGCCAAGGGCCTGGGGCTGAGCAAGGCCTACGTAGGCCAGAAGAGCAGCTTCACAGTAGACTGCAGCAAAGCAGGCA
ACAACATGCTGCTGGTGGGGGTTCATGGCCCAAGGACCCCCTGCGAGGAGATCCTGGTGAAGCACGTGGGCAGCCGG
CTCTACAGCGTGTCCTACCTGCTCAAGGACAAGGGGGAGTACACACTGGTGGTCAAATGGGGGCACGAGCACATCCC
AGGCAGCCCCTACCGCGTTGTGGTGCCCTGAGTCTGGGGCCCGTGCCAGCCGGCAGCCCCCAAGCCTGCCCCGCTAC
CCAAGCAGCCCCGCCCTCTTCCCCTCAACCCCGGCCCAGGCCGCCCTGGCCGCCCGCCTGTCACTGCAGCTGCCCCT
GCCCTGTGCCGTGCTGCGCTCACCTGCCTCCCCAGCCAGCCGCTGACCTCTCGGCTTTCACTTGGGCAGAGGGAGCC
ATTTGGTGGCGCTGCTTGTCTTCTTTGGTTCTGGAGGGGTGAGGATGGGG

FIGURE 89

GGGCGGGCCTCACCCGCTTCGAGTCCTCGGGCTTCCCCCACCCGGCCCGTGGGGGAGTATCTGTCCTGCCGCCTTCG
CCCACGCCCTGCACTCCGGGACCGTCCCTGCGCGCTCTGGGCGACCATGGCCCGCGGGGCTGCGCTGGCGCTGCTGC
TCTTCGGCCTGCTGGGTGTTCTGGTCGCCGCCCCGGATGGTGGTTTCGATTTATCTGATGCCCTTCCTGACAATGAA
AACAAGAAACCCACTGCAATCCCCAAGAAACCCAGTGCTGGGGATGACTTTGACTTAGGAGATGCTGTTGTTGATGG
AGAAAATGACGACCCACGACCACCGAACCCACCCAAACCGATGCCAAATCCAAACCCCAACCACCCTAGTTCCTCCG
GTAGCTTTTCAGATGCTGACCTTGCGGATGGCGTTTCAGGTGGAGAAGGAAAAGGAGGCAGTGATGGTGGAGGCAGC
CACAGGAAAGAAGGGGAAGAGGCCGACGCCCCAGGCGTGATCCCCGGGATTGTGGGGGCTGTCGTGGTCGCCGTGGC
TGGAGCCATCTCTAGCTTCATTGCTTACCAGAAAAAGAAGCTATGCTTCAAAGAAAATGCAGAACAAGGGGAGGTGG
ACATGGAGAGCCACCGGAATGCCAACGCAGAGCCAGCTGTTCAGCGTACTCTTTTAGAGAAATAGAAGATTGTCGGC
AGAAACAGCCCAGGCGTTGGCAGCAGGGTTAGAACAGCTGCCTGAGGCTCCTCCCTGAAGGACACCTGCCTGAGAGC
AGAGATGGAGGCCTTCTGTTCACGGCGGATTCTTTGTTTTAATCTTGCGATGTGCTTTGCTTGTTGCTGGGCGGATG
ATGTTTACTAACGATGAATTTTACATCCAAAGGGGGATAGGCACTTGGACCCCCATTCTCCAAGGCCCGGGGGGGCG
GTTTCCCATGGGATGTGAAAGGCTGGCCATTATTAAGTCCCTGTAACTCAAATGTCAACCCCACCGAGGCACCCCCC
CGTCCCCCAGAATCTTGGCTGTTTACAAATCACGTGTCCATCGAGCACGTCTGAAACCCCTGGTAGCCCCGACTTCT
TTTTAATTAAAATAAGGTAAGCCCTTCAATTT

FIGURE 90A

GCTGCCCCGAGCCTTTCTGGGGAAGAACTCCAGGCGTGCGGACGCAACAGCCGAGAACATTAGGTGTTGTGGACAGG
AGCTGGGACCAAGATCTTCGGCCAGCCCCGCATCCTCCCGCATCTTCCAGCACCGTCCCGCACCCTCCGCATCCTTC
CCCGGGCCACCACGCTTCCTATGTGACCCGCCTGGGCAACGCCGAACCCAGTCGCGCAGCGCTGCAGTGAATTTTCC
CCCCAAACTGCAATAAGCCGCCTTCCAAGGCCAAGATGTTCATAAATATAAAGAGCATCTTATGGATGTGTTCAACC
TTAATAGTAACCCATGCGCTACATAAAGTCAAAGTGGGAAAAAGCCCACCGGTGAGGGGCTCCCTCTCTGGAAAAGT
CAGCCTACCTTGTCATTTTTCAACGATGCCTACTTTGCCACCCAGTTACAACACCAGTGAATTTCTCCGCATCAAAT
GGTCTAAGATTGAAGTGGACAAAAATGGAAAAGATTTGAAAGAGACTACTGTCCTTGTGGCCCAAAATGGAAATATC
AAGATTGGTCAGGACTACAAAGGGAGAGTGTCTGTGCCCACACATCCCGAGGCTGTGGCGATGCCTCCCTCACTGT
GGTCAAGCTGCTGGCAAGTGATGCGGGTCTTTACCGCTGTGACGTCATGTACGGGATTGAAGACACACAAGACACGG
TGTCACTGACTGTGGATGGGGTTGTGTTTCACTACAGGGCGGCAACCAGCAGGTACACACTGAATTTTGAGGCTGCT
CAGAAGGCTTGTTTGGACGTTGGGGCAGTCATAGCAACTCCAGAGCAGCTCTTTGCTGCCTATGAAGATGGATTTGA
GCAGTGTGACGCAGGCTGGCTGGCTGATCAGACTGTCAGATATCCCATCCGGGCTCCCAGAGTAGGCTGTTATGGAG
ATAAGATGGGAAAGGCAGGAGTCAGGACTTATGGATTCCGTTCTCCCCAGGAAACTTACGATGTGTATTGTTATGTG
GATCATCTGGATGGTGATGTGTTCCACCTCACTGTCCCCAGTAAATTCACCTTCGAGGAGGCTGCAAAAGAGTGTGA
AAACCAGGATGCCAGGCTGGCAACAGTGGGGGAACTCCAGGCGGCATGGAGGAACGGCTTTGACCAGTGCGATTACG
GGTGGCTGTCGGATGCCAGCGTGCGCCACCCTGTGACTGTGGCCAGGGCCCAGTGTGGAGGTGGTCTACTTGGGGTG
AGAACCCTGTATCGTTTTGAGAACCAGACAGGCTTCCCTCCCCCTGATAGCAGATTTGATGCCTACTGCTTTAAACG
TCGAATGAGTGATTTGAGTGTAATTGGTCATCCAATAGATTCAGAATCTAAAGAAGATGAACCTTGTAGTGAAGAAA
CAGATCCAGTGCATGATCTAATGGCTGAAATTTTACCTGAATTCCCTGACATAATTGAAATAGACCTATACCACAGT
GAAGAAAATGAAGAAGAAGAAGAAGAGTGTGCAAATGCTACTGATGTGACAACCACCCCATCTGTGCAGTACATAAA
TGGGAAGCATCTCGTTACCACTGTGCCCAAGGACCCAGAAGCTGCAGAAGCTAGGCGTGGCCAGTTTGAAAGTGTTG
CACCTTCTCAGAATTTCTCGGACAGCTCTGAAAGTGATACTCATCCATTTGTAATAGCCAAAACGGAATTGTCTACT
GCTGTGCAACCTAATGAATCTACAGAAACAACTGAGTCTCTTGAAGTTACATGGAAGCCTGAGACTTACCCTGAAAC
ATCAGAACATTTTTCAGGTGGTGAGCCTGATGTTTTCCCCACAGTCCCATTCCATGAGGAATTTGAAAGTGGAACAG
CCAAAAAAGGGGCAGAATCAGTCACAGAGAGAGATACTGAAGTTGGTCATCAGGCACATGAACATACTGAACCTGTA
TCTCTGTTTCCTGAAGAGTCTTCAGGAGAGATTGCCATTGACCAAGAATCTCAGAAAATAGCCTTTGCAAGGGCTAC
AGAAGTAACATTTGGTGAAGAGGTAGAAAAAAGTACTTCTGTCACATACACTCCCACTATAGTTCCAAGTTCTGCAT
CAGCATATGTTTCAGAGGAAGAAGCAGTTACCCTAATAGGAAATCCTTGGCCAGATGACCTGTTGTCTACCAAAGAA
AGCTGGGTAGAAGCAACTCCTAGACAAGTTGTAGAGCTCTCAGGGAGTTCTTCGATTCCAATTACAGAAGGCTCTGG
AGAAGCAGAAGAAGATGAAGATACAATGTTCACCATGGTAACTGATTTATCACAGAGAAATACTACTGATACACTCA
TTACTTTAGACACTAGCAGGATAATCACAGAAAGCTTTTTTGAGGTTCCTGCAACCACCATTTATCCAGTTTCTGAA
CAACCTTCTGCAAAAGTGGTGCCTACCAAGTTTGTAAGTGAAACAGACACTTCTGAGTGGATTTCCAGTACCACTGT
TGAGGAAAAGAAAAGGAAGGAGGAGGAGGGAACTACAGGTACGGCTTCTACATTTGAGGTATATTCATCTACACAGA
GATCGGATCAATTAATTTTACCCTTTGAATTAGAAAGTCCAAATGTAGCTACATCTAGTGATTCAGGTACCAGGAAA
AGTTTTATGTCCTTGACAACACCAACACAGTCTGAAAGGGAAATGACAGATTCTACTCCTGTCTTTACAGAAACAAA
TACATTAGAAAATTTGGGGGCACAGACCACTGAGCACAGCAGTATCCATCAACCTGGGGTTCAGGAAGGGCTGACCA
CTCTCCCACGTAGTCCTGCCTCTGTCTTTATGGAGCAGGGCTCTGGAGAAGCTGCTGCCGACCCAGAAACCACCACT
GTTTCTTCATTTTCATTAAACGTAGAGTATGCAATTCAAGCCGAAAAGGAAGTAGCTGGCACTTTGTCTCCGCATGT
GGAAACTACATTCTCCACTGAGCCAACAGGACTGGTTTTGAGTACAGTAATGGACAGAGTAGTTGCTGAAAATATAA
CCCAAACATCCAGGGAAATAGTGATTTCAGAGCGATTAGGAGAACCAAATTATGGGGCAGAAATAAGGGGCTTTTCC
ACAGGTTTTCCTTTGGAGGAAGATTTCAGTGGTGACTTTAGAGAATACTCAACAGTGTCTCATCCCATAGCAAAAGA
AGAAACGGTAATGATGGAAGGCTCTGGAGATGCAGCATTTAGGGACACCCAGACTTCACCATCTACAGTACCTACTT
CAGTTCACATCAGTCACATATCTGACTCAGAAGGACCCAGTAGCACCATGGTCAGCACTTCAGCCTTCCCCTGGGAA
GAGTTTACATCCTCAGCTGAGGGCTCAGGTGAGCAACTGGTCACAGTCAGCAGCTCTGTTGTTCCAGTGCTTCCCAG
TGCTGTGCAAAAGTTTTCTGGTACAGCTTCCTCCATTATCGACGAAGGATTGGGAGAAGTGGGTACTGTCAATGAAA
TTGATAGAAGATCCACCATTTTACCAACAGCAGAAGTGGAAGGTACGAAAGCTCCAGTAGAGAAGGAGGAAGTAAAG
GTCAGTGGCACAGTTTCAACAAACTTTCCCCAAACTATAGAGCCAGCCAAATTATGGTCTAGGCAAGAAGTCAACCC
TGTAAGACAAGAAATTGAAAGTGAAACAACATCAGAGGAACAAATTCAAGAAGAAAAGTCATTTGAATCCCCTCAAA
ACTCTCCTGCAACAGAACAAACAATCTTTGATTCACAGACATTTACTGAAACTGAACTCAAAACCACAGATTATTCT
GTACTAACAACAAAGAAAACTTACAGTGATGATAAAGAAATGAAGGAGGAAGACACTTCTTTAGTTAACATGTCTAC
TCCAGATCCAGATGCAAATGGCTTGGAATCTTACACAACTCTCCCTGAAGCTACTGAAAAGTCACATTTTTTCTTAG
CTACTGCATTAGTAACTGAATCTATACCAGCTGAACATGTAGTCACAGATTCACCAATCAAAAAGGAAGAAAGTACA
AAACATTTTCCGAAAGGCATGAGACCAACAATTCAAGAGTCAGATACTGAGCTCTTATTCTCTGGACTGGGATCAGG
AGAAGAAGTTTTACCTACTCTACCAACAGAGTCAGTGAATTTTACTGAAGTGGAACAAATCAATAACACATTATATC
CCCACACTTCTCAAGTGGAAAGTACCTCAAGTGACAAAATTGAAGACTTTAACAGAATGGAAAATGTGGCAAAAGAA
GTTGGACCACTCGTATCTCAAACAGACATCTTTGAAGGTAGTGGGTCAGTAACCAGCACAACATTAATAGAAATTTT
AAGTGACACTGGAGCAGAAGGACCCACGGTGGCACCTCTCCCTTTCTCCACGGACATCGGACATCCTCAAAATCAGA
CTGTCAGGTGGGCAGAAGAAATCCAGACTAGTAGACCACAAACCATAACTGAACAAGACTCTAACAAGAATTCTTCA
ACAGCAGAAATTAACGAAACAACAACCTCATCTACTGATTTTCTGGCTAGAGCTTATGGTTTTGAAATGGCCAAAGA
ATTTGTTACATCAGCACCAAAACCATCTGACTTGTATTATGAACCTTCTGGAGAAGGATCTGGAGAAGTGGATATTG
TTGATTCATTTCACACTTCTGCAACTACTCAGGCAACCAGACAAGAAAGCAGCACCACATTTGTTTCTGATGGGTCC
CTGGAAAAACATCCTGAGGTGCCAAGCGCTAAAGCTGTTACTGCTGATGGATTCCCAACAGTTTCAGTGATGCTGCC

FIGURE 90B

TCTTCATTCAGAGCAGAACAAAAGCTCCCCTGATCCAACTAGCACACTGTCAAATACAGTGTCATATGAGAGGTCCA
CAGACGGTAGTTTCCAAGACCGTTTCAGGGAATTCGAGGATTCCACCTTAAAACCTAACAGAAAAAAACCCACTGAA
AATATTATCATAGACCTGGACAAAGAGGACAAGGATTTAATATTGACAATTACAGAGAGTACCATCCTTGAAATTCT
ACCTGAGCTGACATCGGATAAAAATACTATCATAGATATTGATCATACTAAACCTGTGTATGAAGACATTCTTGGAA
TGCAAACAGATATAGATACAGAGGTACCATCAGAACCACATGACAGTAATGATGAAAGTAATGATGACAGCACTCAA
GTTCAAGAGATCTATGAGGCAGCTGTCAACCTTTCTTTAACTGAGGAAACATTTGAGGGCTCTGCTGATGTTCTGGC
TAGCTACACTCAGGCAACACATGATGAATCAATGACTTATGAAGATAGAAGCCAACTAGATCACATGGGCTTTCACT
TCACAACTGGGATCCCTGCTCCTAGCACAGAAACAGAATTAGACGTTTTACTTCCCACGGCAACATCCCTGCCAATT
CCTCGTAAGTCTGCCACAGTTATTCCAGAGATTGAAGGAATAAAAGCTGAAGCAAAAGCCCTGGATGACATGTTTGA
ATCAAGCACTTTGTCTGATGGTCAAGCTATTGCAGACCAAAGTGAAATAATACCAACATTGGGCCAATTTGAAAGGA
CTCAGGAGGAGTATGAAGACAAAAAACATGCTGGTCCTTCTTTTCAGCCAGAATTCTCTTCAGGAGCTGAGGAGGCA
TTAGTAGACCATACTCCCTATCTAAGTATTGCTACTACCCACCTTATGGATCAGAGTGTAACAGAGGTGCCTGATGT
GATGGAAGGATCCAATCCCCCATATTACACTGATACAACATTAGCAGTTTCAACATTTGCGAAGTTGTCTTCTCAGA
CACCATCATCTCCCCTCACTATCTACTCAGGCAGTGAAGCCTCTGGACACACAGAGATCCCCCAGCCCAGTGCTCTG
CCAGGAATAGACGTCGGCTCATCTGTAATGTCCCCACAGGATTCTTTTAAGGAAATTCATGTAAATATTGAAGCAAC
TTTCAAACCATCAAGTGAGGAATACCTTCACATAACTGAGCCTCCCTCTTTATCTCCTGACACAAAATTAGAACCTT
CAGAAGATGATGGTAAACCTGAGTTATTAGAAGAAATGGAAGCTTCTCCCACAGAACTTATTGCTGTGGAAGGAACT
GAGATTCTCCAAGATTTCCAAAACAAAACCGATGGTCAAGTTTCTGGAGAAGCAATCAAGATGTTTCCCACCATTAA
AACACCTGAGGCTGGAACTGTTATTACAACTGCCGATGAAATTGAATTAGAAGGTGCTACACAGTGGCCACACTCTA
CTTCTGCTTCTGCCACCTATGGGGTCGAGGCAGGTGTGGTGCCTTGGCTAAGTCCACAGACTTCTGAGAGGCCCACG
CTTTCTTCTTCTCCAGAAATAAACCCTGAAACTCAAGCAGCTTTAATCAGAGGGCAGGATTCCACGATAGCAGCATC
AGAACAGCAAGTGGCAGCGAGAATTCTTGATTCCAATGATCAGGCAACAGTAAACCCTGTGGAATTTAATACTGAGG
TTGCAACACCACCATTTTCCCTTCTGGAGACTTCTAATGAAACAGATTTCCTGATTGGCATTAATGAAGAGTCAGTG
GAAGGCACGGCAATCTATTTACCAGGACCTGATCGCTGCAAAATGAACCCGTGCCTTAACGGAGGCACCTGTTATCC
TACTGAAACTTCCTACGTATGCACCTGTGTGCCAGGATACAGCGGAGACCAGTGTGAACTTGATTTTGATGAATGTC
ACTCTAATCCCTGTCGTAATGGAGCCACTTGTGTTGATGGTTTTAACACATTCAGGTGCCTCTGCCTTCCAAGTTAT
GTTGGTGCACTTTGTGAGCAAGATACCGAGACATGTGACTATGGCTGGCACAAATTCCAAGGGCAGTGCTACAAATA
CTTTGCCCATCGACGCACATGGGATGCAGCTGAACGGGAATGCCGTCTGCAGGGTGCCCATCTCACAAGCATCCTGT
CTCACGAAGAACAAATGTTTGTTAATCGTGTGGGCCATGATTATCAGTGGATAGGCCTCAATGACAAGATGTTTGAG
CATGACTTCCGTTGGACTGATGGCAGCACACTGCAATACGAGAATTGGAGACCCAACCAGCCAGACAGCTTCTTTTC
TGCTGGAGAAGACTGTGTTGTAATCATTTGGCATGAGAATGGCCAGTGGAATGATGTTCCCTGCAATTACCATCTCA
CCTATACGTGCAAGAAAGGAACAGTTGCTTGCGGCCAGCCCCCTGTTGTAGAAAATGCCAAGACCTTTGGAAAGATG
AAACCTCGTTATGAAATCAACTCCCTGATTAGATACCACTGCAAAGATGGTTTCATTCAACGTCACCTTCCAACTAT
CCGGTGCTTAGGAAATGGAAGATGGGCTATACCTAAAATTACCTGCATGAACCCATCTGCATACCAAAGGACTTATT
CTATGAAATACTTTAAAAATTCCTCATCAGCAAAGGACAATTCAATAAATACATCCAAACATGATCATCGTTGGAGC
CGGAGGTGGCAGGAGTCGAGGCGC<u>TGA</u>TCCCTAAAATGGCGAACATGTGTTTTCATCATTTCAGCCAAAGTCCTAAC
TTCCTGTGCCTTTCCTATCACCTCGAGAAGTAATTATCAGTTGGTTTGGATTTTTGGACCACCGTTCAGTCATTTTG
GGTTGCCGTGCTCCCAAAACATTTTAAATGAAAGTATTGGCATTCAAAAAGACAGCAGACAAAATGAAAGAAAATGA
GAGCAGAAAGTAAGCATTTCCAGCCTATCTAATTTCTTTAGTTTTCTATTTGCCTCCAGTGCAGTCCATTTCCTAAT
GTATACCAGCCTACTGTACTATTTAAAATGCTCAATTTCAGCACCGATGGCCATGTAAATAAGATGATTTAATGTTG
ATTTTAATCCTGTATATAAAATAAAAAGTCACAATGAGTTTGGGCATATTTAATGATGATTATGGAGCCTTAGAGGT
CTTTAATCATTGGTTCGGCTGCTTTTATGTAGTTTAGGCTGGAAATGGTTTCACTTGCTCTTTGACTGTCAGCAAGA
CTGAAGATGGCTTTTCCTGGACAGCTAGAAAACACAAAATCTTGTAGGTCATTGCACCTATCTCAGCCATAGGTGCA
GTTTGCTTCTACATGATGCTAAAGGCTGCGAATGGGATCCTGATGGAACTAAGGACTCCAATGTCGAACTCTTCTTT
GCTGCATTCCTTTTTCTTCACTTACAAGAAAGGCCTGAATGGAGGACTTTTCTGTAACCAGG

FIGURE 91

CCAATCGCCCGGTGCGGTGGTGCAGGGTCTCGGGCTAGTCATGGCGTCCCCGTCTCGGAGACTGCAGACTAAACCAG
TCATTACTTGTTTCAAGAGCGTTCTGCTAATCTACACTTTTATTTTCTGGATCACTGGCGTTATCCTTCTTGCAGTT
GGCATTTGGGGCAAGGTGAGCCTGGAGAATTACTTTTCTCTTTTAAATGAGAAGGCCACCAATGTCCCCTTCGTGCT
CATTGCTACTGGTACCGTCATTATTCTTTTGGGCACCTTTGGTTGTTTTGCTACCTGCCGAGCTTCTGCATGGATGC
TAAAACTGTATGCAATGTTTCTGACTCTCGTTTTTTTGGTCGAACTGGTCGCTGCCATCGTAGGATTTGTTTTCAGA
CATGAGATTAAGAACAGCTTTAAGAATAATTATGAGAAGGCTTTGAAGCAGTATAACTCTACAGGAGATTATAGAAG
CCATGCAGTAGACAAGATCCAAAATACGTTGCATTGTTGTGGTGTCACCGATTATAGAGATTGGACAGATACTAATT
ATTACTCAGAAAAAGGATTTCCTAAGAGTTGCTGTAAACTTGAAGATTGTACTCCACAGAGAGATGCAGACAAAGTA
AACAATGAAGGTTGTTTTATAAAGGTGATGACCATTATAGAGTCAGAAATGGGAGTCGTTGCAGGAATTTCCTTTGG
AGTTGCTTGCTTCCAACTGATTGGAATCTTTCTCGCCTACTGCCWCTCTCGTGCCATAACAAATAACCAGTATGAGA
TAGTGTAACCCAATGTATCTGTGGGCCTATTCCTCTCTACCTTTAAGGACATTTAGGGTCCCCCCTGTGAATTAGAA
AGTTGCTTGGCTGGAGAACTGACAACACTACTTACTGATAGACCAAAAAACTACACCAGTAGGTTGATTCAATCAAG
ATGTATGTAGACCTAAAACTACACCAATAGGCTGATTCAATCAAGATCCGTGCTCGCAGTGGGCTGATTCAATCAAG
ATGTATGTTTGCTATGTTCTAAGTCCACCTTCTATCCCATTCATGTTAGATCGTTGAAACCCTGTATCCCTCTGAAA
CACTGGAAGAGCTAGTAAATTGTAAATGAAGT

FIGURE 92A

CAAACATGTCAGCTGTTACTGGAAGTGGCCTGGCCTCTATTTATCTTCCTGATCCTGATCTCTGTTCGGCTGAGCTA
CCCACCCTATGAACAACATGAATGCCATTTTCCAAATAAAGCC<u>ATG</u>CCCTCTGCAGGAACACTTCCTTGGGTTCAGG
GGATTATCTGTAATGCCAACAACCCCTGTTTCCGTTACCCGACTCCTGGGGAGGCTCCCGGAGTTGTTGGAAACTTT
AACAAATCCATTGTGGCTCGCCTGTTCTCAGATGCTCGGAGGCTTCTTTTATACAGCCAGAAAGACACCAGCATGAA
GGACATGCGCAAAGTTCTGAGAACATTACAGCAGATCAAGAAATCCAGCTCAAACTTGAAGCTTCAAGATTTCCTGG
TGGACAATGAAACCTTCTCTGGGTTCCTGTATCACAACCTCTCTCTCCCAAAGTCTACTGTGGACAAGATGCTGAGG
GCTGATGTCATTCTCCACAAGGTATTTTTGCAAGGCTACCAGTTACATTTGACAAGTCTGTGCAATGGATCAAAATC
AGAAGAGATGATTCAACTTGGTGACCAAGAAGTTTCTGAGCTTTGTGGCCTACCAAGGGAGAAACTGGCTGCAGCAG
AGCGAGTACTTCGTTCCAACATGGACATCCTGAAGCCAATCCTGAGAACACTAAACTCTACATCTCCCTTCCCGAGC
AAGGAGCTGGCCGAAGCCACAAAAACATTGCTGCATAGTCTTGGGACTCTGGCCCAGGAGCTGTTCAGCATGAGAAG
CTGGAGTGACATGCGACAGGAGGTGATGTTTCTGACCAATGTGAACAGCTCCAGCTCCTCCACCCAAATCTACCAGG
CTGTGTCTCGTATTGTCTGCGGGCATCCCGAGGGAGGGGGGCTGAAGATCAAGTCTCTCAACTGGTATGAGGACAAC
AACTACAAAGCCCTCTTTGGAGGCAATGGCACTGAGGAAGATGCTGAAACCTTCTATGACAACTCTACAACTCCTTA
CTGCAATGATTTGATGAAGAATTTGGAGTCTAGTCCTCTTTCCCGCATTATCTGGAAAGCTCTGAAGCCGCTGCTCG
TTGGGAAGATCCTGTATACACCTGACACTCCAGCCACAAGGCAGGTCATGGCTGAGGTGAACAAGACCTTCCAGGAA
CTGGCTGTGTTCCATGATCTGGAAGGCATGTGGGAGGAACTCAGCCCCAAGATCTGGACCTTCATGGAGAACAGCCA
AGAAATGGACCTTGTCCGGATGCTGTTGGACAGCAGGGACAATGACCACTTTTGGGAACAGCAGTTGGATGGCTTAG
ATTGGACAGCCCAAGACATCGTGGCGTTTTTGGCCAAGCACCCAGAGGATGTCCAGTCCAGTAATGGTTCTGTGTAC
ACCTGGAGAGAAGCTTTCAACGAGACTAACCAGGCAATCCGGACCATATCTCGCTTCATGGAGTGTGTCAACCTGAA
CAAGCTAGAACCCATAGCAACAGAAGTCTGGCTCATCAACAAGTCCATGGAGCTGCTGGATGAGAGGAAGTTCTGGG
CTGGTATTGTGTTCACTGGAATTACTCCAGGCAGCATTGAGCTGCCCCATCATGTCAAGTACAAGATCCGAATGGAC
ATTGACAATGTGGAGAGGACAAATAAAATCAAGGATGGGTACTGGGACCCTGGTCCTCGAGCTGACCCCTTTGAGGA
CATGCGGTACGTCTGGGGGGGCTTCGCCTACTTGCAGGATGTGGTGGAGCAGGCAATCATCAGGGTGCTGACGGGCA
CCGAGAAGAAAACTGGTGTCTATATGCAACAGATGCCCTATCCCTGTTACGTTGATGACATCTTTCTGCGGGTGATG
AGCCGGTCAATGCCCCTCTTCATGACGCTGGCCTGGATTTACTCAGTGGCTGTGATCATCAAGGGCATCGTGTATGA
GAAGGAGGCACGGCTGAAAGAGACCATGCGGATCATGGGCCTGGACAACAGCATCCTCTGGTTTAGCTGGTTCATTA
GTAGCCTCATTCCTCTTCTTGTGAGCGCTGGCCTGCTAGTGGTCATCCTGAAGTTAGGAAACCTGCTGCCCTACAGT
GATCCCAGCGTGGTGTTTGTCTTCCTGTCCGTGTTTGCTGTGGTGACAATCCTGCAGTGCTTCCTGATTAGCACACT
CTTCTCCAGAGCCAACCTGGCAGCAGCCTGTGGGGGCATCATCTACTTCACGCTGTACCTGCCCTACGTCCTGTGTG
TGGCATGGCAGGACTACGTGGGCTTCACACTCAAGATCTTCGCTAGCCTGCTGTCTCCTGTGGCTTTTGGGTTTGGC
TGTGAGTACTTTGCCCTTTTTGAGGAGCAGGGCATTGGAGTGCAGTGGGACAACCTGTTTGAGAGTCCTGTGGAGGA
AGATGGCTTCAATCTCACCACTTCGGTCTCCATGATGCTGTTTGACACCTTCCTCTATGGGGTGATGACCTGGTACA
TTGAGGCTGTCTTTCCAGGCCAGTACGGAATTCCCAGGCCCTGGTATTTTCCTTGCACCAAGTCCTACTGGTTTGGC
GAGGAAAGTGATGAGAAGAGCCACCCTGGTTCCAACCAGAAGAGAATATCAGAAATCTGCATGGAGGAGGAACCCAC
CCACTTGAAGCTGGGCGTGTCCATTCAGAACCTGGTAAAAGTCTACCGAGATGGGATGAAGGTGGCTGTCGATGGCC
TGGCACTGAATTTTTATGAGGGCCAGATCACCTCCTTCCTGGGCCACAATGGAGCGGGGAAGACGACCACCATGTCA
ATCCTGACCGGGTTGTTCCCCCCGACCTCGGGCACCGCCTACATCCTGGGAAAAGACATTCGCTCTGAGATGAGCAC
CATCCGGCAGAACCTGGGGGTCTGTCCCCAGCATAACGTGCTGTTTGACATGCTGACTGTCGAAGAACACATCTGGT
TCTATGCCCGCTTGAAAGGGCTCTCTGAGAAGCACGTGAAGGCGGAGATGGAGCAGATGGCCCTGGATGTTGGTTTG
CCATCAAGCAAGCTGAAAAGCAAAACAAGCCAGCTGTCAGGTGGAATGCAGAGAAAGCTATCTGTGGCCTTGGCCTT
TGTCGGGGGATCTAAGGTTGTCATTCTGGATGAACCCACAGCTGGTGTGGACCCTTACTCCCGCAGGGGAATATGGG
AGCTGCTGCTGAAATACCGACAAGGCCGCACCATTATTCTCTCTACACACCACATGGATGAAGCGGACGTCCTGGGG
GACAGGATTGCCATCATCTCCCATGGGAAGCTGTGCTGTGTGGGCTCCTCCCTGTTTCTGAAGAACCAGCTGGGAAC
AGGCTACTACCTGACCTTGGTCAAGAAAGATGTGGAATCCTCCCTCAGTTCCTGCAGAAACAGTAGTAGCACTGTGT
CATACCTGAAAAAGGAGGACAGTGTTTCTCAGAGCAGTTCTGATGCTGGCCTGGGCAGCGACCATGAGAGTGACACG
CTGACCATCGATGTCTCTGCTATCTCCAACCTCATCAGGAAGCATGTGTCTGAAGCCCGGCTGGTGGAAGACATAGG
GCATGAGCTGACCTATGTGCTGCCATATGAAGCTGCTAAGGAGGGAGCCTTTGTGGAACTCTTTCATGAGATTGATG
ACCGGCTCTCAGACCTGGGCATTTCTAGTTATGGCATCTCAGAGACGACCCTGGAAGAAATATTCCTCAAGGTGGCC
GAAGAGAGTGGGGTGGATGCTGAGACCTCAGATGGTACCTTGCCAGCAAGACGAAACAGGCGGGCCTTCGGGGACAA
GCAGAGCTGTCTTCGCCCGTTCACTGAAGATGATGCTGCTGATCCAAATGATTCTGACATAGACCCAGAATCCAGAG
AGACAGACTTGCTCAGTGGGATGGATGGCAAAGGGTCCTACCAGGTGAAAGGCTGGAAACTTACACAGCAACAGTTT
GTGGCCCTTTTGTGGAAGAGACTGCTAATTGCCAGACGGAGTCGGAAAGGATTTTTTGCTCAGATTGTCTTGCCAGC
TGTGTTTGTCTGCATTGCCCTTGTGTTCAGCCTGATCGTGCCACCCTTTGGCAAGTACCCCAGCCTGGAACTTCAGC
CCTGGATGTACAACGAACAGTACACATTTGTCAGCAATGATGCTCCTGAGGACACGGGAACCCTGGAACTCTTAAAC
GCCCTCACCAAAGACCCTGGCTTCGGGACCCGCTGTATGGAAGGAAACCCAATCCCAGACACGCCCTGCCAGGCAGG
GGAGGAAGAGTGGACCACTGCCCCAGTTCCCCAGACCATCATGGACCTCTTCCAGAATGGGAACTGGACAATGCAGA
ACCCTTCACCTGCATGCCAGTGTAGCAGCGACAAAATCAAGAAGATGCTGCCTGTGTGTCCCCCAGGGGCAGGGGGG
CTGCCTCCTCCACAAAGAAAACAAAACACTGCAGATATCCTTCAGGACCTGACAGGAAGAAACATTTCGGATTATCT
GGTGAAGACGTATGTGCAGATCATAGCCAAAAGCTTAAAGAACAAGATCTGGGTGAATGAGTTTAGGTATGGCGGCT
TTTCCCTGGGTGTCAGTAATACTCAAGCACTTCCTCCGAGTCAAGAAGTTAATGATGCCACCAAACAAATGAAGAAA
CACCTAAAGCTGGCCAAGGACAGTTCTGCAGATCGATTTCTCAACAGCTTGGGAAGATTTATGACAGGACTGGACAC
CAGAAATAATGTCAAGGTGTGGTTCAATAACAAGGGCTGGCATGCAATCAGCTCTTTCCTGAATGTCATCAACAATG

FIGURE 92B

CCATTCTCCGGGCCAACCTGCAAAAGGGAGAGAACCCTAGCCATTATGGAATTACTGCTTTCAATCATCCCCTGAAT
CTCACCAAGCAGCAGCTCTCAGAGGTGGCTCCGATGACCACATCAGTGGATGTCCTTGTGTCCATCTGTGTCATCTT
TGCAATGTCCTTCGTCCCAGCCAGCTTTGTCGTATTCCTGATCCAGGAGCGGGTCAGCAAAGCAAAACACCTGCAGT
TCATCAGTGGAGTGAAGCCTGTCATCTACTGGCTCTCTAATTTTGTCTGGGATATGTGCAATTACGTTGTCCCTGCC
ACACTGGTCATTATCATCTTCATCTGCTTCCAGCAGAAGTCCTATGTGTCCTCCACCAATCTGCCTGTGCTAGCCCT
TCTACTTTTGCTGTATGGGTGGTCAATCACACCTCTCATGTACCCAGCCTCCTTTGTGTTCAAGATCCCCAGCACAG
CCTATGTGGTGCTCACCAGCGTGAACCTCTTCATTGGCATTAATGGCAGCGTGGCCACCTTTGTGCTGGAGCTGTTC
ACCGACAATAAGCTGAATAATATCAATGATATCCTGAAGTCCGTGTTCTTGATCTTCCCACATTTTTGCCTGGGACG
AGGGCTCATCGACATGGTGAAAAACCAGGCAATGGCTGATGCCCTGGAAAGGTTTGGGGAGAATCGCTTTGTGTCAC
CATTATCTTGGGACTTGGTGGGACGAAACCTCTTCGCCATGGCCGTGGAAGGGGTGGTGTTCTTCCTCATTACTGTT
CTGATCCAGTACAGATTCTTCATCAGGCCCAGACCTGTAAATGCAAAGCTATCTCCTCTGAATGATGAAGATGAAGA
TGTGAGGCGGGAAAGACAGAGAATTCTTGATGGTGGAGGCCAGAATGACATCTTAGAAATCAAGGAGTTGACGAAGA
TATATAGAAGGAAGCGGAAGCCTGCTGTTGACAGGATTTGCGTGGGCATTCCTCCTGGTGAGTGCTTTGGGCTCCTG
GGAGTTAATGGGGCTGGAAAATCATCAACTTTCAAGATGTTAACAGGAGATACCACTGTTACCAGAGGAGATGCTTT
CCTTAACAGAAATAGTATCTTATCAAACATCCATGAAGTACATCAGAACATGGGCTACTGCCCTCAGTTTGATGCCA
TCACAGAGCTGTTGACTGGGAGAGAACACGTGGAGTTCTTTGCCCTTTTGAGAGGAGTCCCAGAGAAAGAAGTTGGC
AAGGTTGGTGAGTGGGCGATTCGGAAACTGGGCCTCGTGAAGTATGGAGAAAAATATGCTGGTAACTATAGTGGAGG
CAACAAACGCAAGCTCTCTACAGCCATGGCTTTGATCGGCGGGCCTCCTGTGGTGTTTCTGGATGAACCCACCACAG
GCATGGATCCCAAAGCCCGGCGGTTCTTGTGGAATTGTGCCCTAAGTGTTGTCAAGGAGGGGAGATCAGTAGTGCTT
ACATCTCATAGTATGGAAGAATGTGAAGCTCTTTGCACTAGGATGGCAATCATGGTCAATGGAAGGTTCAGGTGCCT
TGGCAGTGTCCAGCATCTAAAAAATAGGTTTGGAGATGGTTATACAATAGTTGTACGAATAGCAGGGTCCAACCCGG
ACCTGAAGCCTGTCCAGGATTTCTTTGGACTTGCATTTCCTGGAAGTGTTCCAAAAGAGAAACACCGGAACATGCTA
CAATACCAGCTTCCATCTTCATTATCTTCTCTGGCCAGGATATTCAGCATCCTCTCCCAGAGCAAAAAGCGACTCCA
CATAGAAGACTACTCTGTTTCTCAGACAACACTTGACCAAGTATTTGTGAACTTTGCCAAGGACCAAAGTGATGATG
ACCACTTAAAAGACCTCTCATTACACAAAAACCAGACAGTAGTGGACGTTGCAGTTCTCACATCTTTTCTACAGGAT
GAGAAAGTGAAAGAAAGCTATGTATGAAGAATCCTGTTCATACGGGGTGGCTGAAAGTAAAGAGGXACTAGACTTTC
CTTTGCACCATGTGAAGTGTTGTGGAGAAAAGAGCCAGAAGTTGATGTGGGAAGAAGTAAACTGGATACTGTACTGA
TACTATTCAATGCAATGCAATTCAATGCAATGAAAACAAAATTCCATTACAGGGGCAGTGCCTTTGTAGCCTATGTC
TTGTATGGCTCTCAAGTGAAAGACTTGAATTTAGTTTTTTACCTATACCTATGTGAAACTCTATTATGGAACCCAAT
GGACATATGGGTTTGAACTCACACTTTTTTTTTTTTTTTGTTCCTGTGTATTCTCATTGGGGTTGCAACAATAATTC
ATCAAGTAATCATGGCCAGCGATTATTGATCAAAATCAAAAGGTAATGCACATCCTCATTCACTAAGCCATGCCATG
CCCAGGAGACTGGTTTCCCGGTGACACATCCATTGCTGGCAATGAGTGTGCCAGAGTTATTAGTGCCAAGTTTTTCA
GAAAGTTTGAAGCACCATGGTGTGTCATGCTCACTTTTGTGAAAGCTGCTCTGCTCAGAGTCTATCAACATTGAATA
TCAGTTGACAGAATGGTGCCATGCGTGGCTAACATCCTGCTTTGATTCCCTCTGATAAGCTGTTCTGGTGGCAGTAA
CATGCAACAAAAATGTGGGTGTCTCTAGGCACGGGAAACTTGGTTCCATTGTTATATTGTCCTATGCTTCGAGCCAT
GGGTCTACAGGGTCATCCTTATGAGACTCTTAAATATACTTAGATCCTGGTAAGAGGCAAAGAATCAACAGCCAAAC
TGCTGGGGCTGCAAGCTGCTGAAGCCAGGGCATGGGATTAAAGAGATTGTGCGTTCAAACCTAGGGAAGCCTGTGCC
CATTTGTCCTGACTGTCTGCTAACATGGTACACTGCATCTCAAGATGTTTATCTGACACAAGTGTATTATTTCTGGC
TTTTTGAATTAATCTAGAAAATGAAAAGATGGAGTTGTATTTTGACAAAAATGTTTGTACTTTTTAATGTTATTTGG
AATTTTAAGTTCTATCAGTGACTTCTGAATCCTTAGAATGGCCTCTTTGTAGAACCCTGTGGTATAGAGGAGTATGG
CCACTGCCCCACTATTTTTATTTTCTTATGTAAGTTTGCATATCAGTCATGACTAGTGCCTAGAAAGCAATGTGATG
GTCAGGATCTCATGACATTATATTTGAGTTTCTTTCAGATCATTTAGGATACTCTTAATCTCACTTCATCAATCAAA
TATTTTTTGAGTGTATGCTGTAGCTGAAAGAGTATGTACGTACGTATAAGACTAGAGAGATATTAAGTCTCAGTACA
CTTCCTGTGCCATGTTATTCAGCTCACTGGTTTACAAATATAGGTTGTCTTGTGGTTGTAGGAGCCCACTGTAACAA
TACTGGGCAGCCTTTTTTTTTTTTTTTTAATTGCAACAATGCAAAAGCCAAGAAAGTATAAGGGTCACAAGTCTAAAC
AATGAATTCTTCAACAGGGAAAACAGCTAGCTTGAAAACTTGCTGAAAAACACAACTTGTGTTTATGGCATTTAGTA
CCTTCAAATAATTGGCTTTGCAGATATTGGATACCCCATTAAATCTGACAGTCTCAAATTTTTCATCTCTTCAATCA
CTAGTCAAGAAAAATATAAAAACAACAAATACTTCCATATGGAGCATTTTTCAGAGTTTTCTAACCCAGTCTTATTT
TTCTAGTCAGTAAACATTTGTAAAAATACTGTTTCACTAATACTTACTGTTAACTGTCTTGAGAGAAAAGAAAAATA
TGAGAGAACTATTGTTTGGGGAAGTTCAAGTGATCTTTCAATATCATTACTAACTTCTTCCACTTTTTCCAAAATTT
GAATATTAACGCTAAAGGTGTAAGACTTCAGATTTCAAATTAATCTTTCTATATTTTTTAAATTTACAGAATATTAT
ATAACCCACTGCTGAAAAAGAAAAAAATGATTGTTTTAGAAGTTAAAGTCAATATTGATTTTAAATATAAGTAATGA
AGGCATATTTCCAATAACTAGTGATATGGCATCGTTGCATTTTACAGTATCTTCAAAAATACAGAATTTATAGAATA
ATTTCTCCTCATTTAATATTTTTCAAAATCAAAGTTATGGTTTCCTCATTTTACTAAAATCGTATTCTAATTCTTCA
TTATAGTAAATCTATGAGCAACTCCTTACTTCGGTTCCTCTGATTTCAAGGCCATATTTTAAAAAATCAAAAGGCAC
TGTGAACTATTTTGAAGAAAACACAACATTTTAATACAGATTGAAAGGACCTCTTCTGAAGCTAGAAACAATCTATA
GTTATACATCTTCATTAATACTGTGTTACCTTTTAAAATAGTAATTTTTTACATTTTCCTGTGTAAACCTAATTGTG
GTAGAAATTTTTACCAACTCTATACTCAATCAAGCAAAATTTCTGTATATTCCCTGTGGAATGTACCTATGTGAGTT
TCAGAAATTCTCAAAATACGTGTTCAAAAATTTCTGCTTTTGCATCTTTGGGACACCTCAGAAAACTTATTAACAAC
TGTGAATATGAGAAATACAGAAGAAAATAATAAGCCCTCTATACATAAATGCCCAGCACAATTCATTGTTAAAAAAC
AACCAAACCTCACACTACTGTATTTCATTATCTGTACTGAAAGCAAATGCTTTGTGACTATTAAATGTTGCACATCA
TTCATTCACTGTATAGTAATCATTGACTAAAGCCATTTGTCTGTGTTTTCTTCTTGTGGTTGTATATATCAGGTAAA
ATATTTTCCAAAGAGCCATGTGTCATGTAATACTGAACCACTTTGATATTGAGACATTAATTTGTACCCTTGTTATT

FIGURE 92C

ATCTACTAGTAATAATGTAATACTGTAGAAATATTGCTCTAATTCTTTTCAAAATTGTTGCATCCCCCTTAGAATGT
TTCTATTTCCATAAGGATTTAGGTATGCTATTATCCCTTCTTATACCCTAAGATGAAGCTGTTTTTGTGCTCTTTGT
TCATCATTGGCCCTCATTCCAAGCACTTTACGCTGTCTGTAATGGGATCTATTTTTGCACTGGAATATCTGAGAATT
GCAAAACTAGACAAAAGTTTCACAACAGATTTCTAAGTTAAATCATTTTCATTAAAAGGAAAAAAGAAAAAAAATTT
TGTATGTCAATAACTTTATATGAAGTATTAAAATGCATATTTCTATGTTGTAATATAATGAGTCACAAAATAAAGCT
GTGACAGTTCTGTTGGTCTACAGAAATTTACTTTTGTGCATTTGTGGCACCACCTACTGTTGAAGGGTTATAAAGCC
ATTAGAAAAGTAGAGGGGAAGTGATTTGGATCAAAAGGAAAAACTTTAGAAAAGATTCAGATGTTCCCTTAATCATA
AAAGAGAACTGAGGGGACTACTTGAAAATAAAAGGTTGTTTTGTATTTTCATGTTGGTTAAGATACTGAGTAACTGG
TATTAAGTGTTAGAGGTTTTTAGATAAATATTCTGCTTAATGATTATGAAGCTGCACTGAGATTTCTGAAAATGCTC
TGTAGCTGAGCTTATTTAATAAATGTTCACTTGGTATAGGGGAAGCTACAAAGGCAGCCTTCAGTGTCCTTTTGTTT
ATTCAACCAAAAATATAAGGACACAATGTAGCAGTTATACTGGGAAGGTGCTGGGGGTGGTGGCAATGGTGAGCAGG
AAGGCG

FIGURE 93

CGCGCCCCCCAGTCCCGCACCCGTTCGGCCCAGGCTAAGTTAGCCCTCACCATGCCGGTCAAAGGAGGCACCAAGTG
CATCAAATACCTGCTGTTCGGATTTAACTTCATCTTCTGGCTTGCCGGGATTGCTGTCCTTGCCATTGGACTATGGC
TCCGATTCGACTCTCAGACCAAGAGCATCTTCGAGCAAGAAACTAATAATAATAATTCCAGCTTCTACACAGGAGTC
TATATTCTGATCGGAGCCGGCGCCCTCATGATGCTGGTGGGCTTCCTGGGCTGCTGCGGGGCTGTGCAGGAGTCCCA
GTGCATGCTGGGACTGTTCTTCGGCTTCCTCTTGGTGATATTCGCCATTGAAATAGCTGCGGCCATCTGGGGATATT
CCCACAAGGATGAGGTGATTAAGGAAGTCCAGGAGTTTTACAAGGACACCTACAACAAGCTGAAAACCAAGGATGAG
CCCCAGCGGGAAACGCTGAAAGCCATCCACTATGCGTTGAACTGCTGTGGTTTGGCTGGGGGCGTGGAACAGTTTAT
CTCAGACATCTGCCCCAAGAAGGACGTACTCGAAACCTTCACCGTGAAGTCCTGTCCTGATGCCATCAAAGAGGTCT
TCGACAATAAATTCCACATCATCGGCGCAGTGGGCATCGGCATTGCCGTGGTCATGATATTTGGCATGATCTTCAGT
ATGATCTTGTGCTGTGCTATCCGCAGGAACCGCGAGATGGTCTAGAGTCAGCTTACATCCCTGAGCAGGAAAGTTTA
CCCATGAAGATTGGTGGGATTTTTTGTTTGTTTGTTTTGTTTTGTTTGTTGTTTGTTGTTTGTTTTTTTGCCACTAA
TTTTAGTATTCATTCTGCATTGCTAGATAAAAGCTGAAGTTACTTTATGTTTGTCTTTTAATGCTTCATTCAATATT
GACATTTGTAGTTGAGCGGGGGGTTTGGTTTGCTTGGTTTATATTTTTCAGTTGTTTGTTTTTGCTTGTTATATTAA
GCAGAAATCCTGCAATGAAAGGTACTATATTTGCTAGACTCTAGACAAGATATTGTACATAAAAGAATTTTTTTGTC
TTTAAATAGATACAAATGTCTATCAACTTTAATCAAGTTGTAACTTATATTGAAGACAATTTGATACATAATAAAAA
ATTATGACAATGAAAAAAAAAAAAAAAAAAAAAAAAAGG

FIGURE 94

GGAAGGGGAGGAGCAGGCCACACAGGCACAGGCCGGTGAGGGACCTGCCCAGACCTGGAGGGTCTCGCTCTGTCACA
CAGGCTGGAGTGCAGTGGTGTGATCTTGGCTCATCGTAACCTCCACCTCCCGGGTTCAAGTGATTCTCATGCCTCAG
CCTCCCGAGTAGCTGGGATTACAGGTGGTGACTTCCAAGAGTGACTCCGTCGGAGGAAAATGACTCCCCAGTCGCTG
CTGCAGACGACACTGTTCCTGCTGAGTCTGCTCTTCCTGGTCCAAGGTGCCCACGGCAGGGGCCACAGGGAAGACTT
TCGCTTCTGCAGCCAGCGGAACCAGACACACAGGAGCAGCCTCCACTACAAACCCACACCAGACCTGCGCATCTCCA
TCGAGAACTCCGAAGAGGCCCTCACAGTCCATGCCCCTTTCCCTGCAGCCCACCCTGCTTCCCGATCCTTCCCTGAC
CCCAGGGGCCTCTACCACTTCTGCCTCTACTGGAACCGACATGCTGGGAGATTACATCTTCTCTATGGCAAGCGTGA
CTTCTTGCTGAGTGACAAAGCCTCTAGCCTCCTCTGCTTCCAGCACCAGGAGGAGAGCCTGGCTCAGGGCCCCCCGC
TGTTAGCCACTTCTGTCACCTCCTGGTGGAGCCCTCAGAACATCAGCCTGCCCAGTGCCGCCAGCTTCACCTTCTCC
TTCCACAGTCCTCCCCACACGGCCGCTCACAATGCCTCGGTGGACATGTGCGAGCTCAAAAGGGACCTCCAGCTGCT
CAGCCAGTTCCTGAAGCATCCCCAGAAGGCCTCAAGGAGGCCCTCGGCTGCCCCCGCCAGCCAGCAGTTGCAGAGCC
TGGAGTCGAAACTGACCTCTGTGAGATTCATGGGGGACATGGTGTCCTTCGAGGAGGACCGGATCAACGCCACGGTG
TGGAAGCTCCAGCCCACAGCCGGCCTCCAGGACCTGCACATCCACTCCCGGCAGGAGGAGGAGCAGAGCGAGATCAT
GGAGTACTCGGTGCTGCTGCCTCGAACACTCTTCCAGAGGACGAAAGGCCGGAGCGGGGAGGCTGAGAAGAGACTCC
TCCTGGTGGACTTCAGCAGCCAAGCCCTGTTCCAGGACAAGAATTCCAGCCAAGTCCTGGGTGAGAAGGTCTTGGGG
ATTGTGGTACAGAACACCAAAGTAGCCAACCTCACGGAGCCCGTGGTGCTCACTTTCCAGCACCAGCTACAGCCGAA
GAATGTGACTCTGCAATGTGTGTTCTGGGTTGAAGACCCCACATTGAGCAGCCCGGGGCATTGGAGCAGTGCTGGGT
GTGAGACCGTCAGGAGAGAAACCCAAACATCCTGCTTCTGCAACCACTTGACCTACTTTGCAGTGCTGATGGTCTCC
TCGGTGGAGGTGGACGCCGTGCACAAGCACTACCTGAGCCTCCTCTCCTACGTGGGCTGTGTCGTCTCTGCCCTGGC
CTGCCTTGTCACCATTGCCGCCTACCTCTGCTCCAGGGTGCCCCTGCCGTGCAGGAGGAAACCTCGGGACTACACCA
TCAAGGTGCACATGAACCTGCTGCTGGCCGTCTTCCTGCTGGACACGAGCTTCCTGCTCAGCGAGCCGGTGGCCCTG
ACAGGCTCTGAGGCTGGCTGCCGAGCCAGTGCCATCTTCCTGCACTTCTCCCTGCTCACCTGCCTTTCCTGGATGGG
CCTCGAGGGGTACAACCTCTACCGACTCGTGGTGGAGGTCTTTGGCACCTATGTCCCTGGCTACCTACTCAAGCTGA
GCGCCATGGGCTGGGGCTTCCCCATCTTTCTGGTGACGCTGGTGGCCCTGGTGGATGTGGACAACTATGGCCCCATC
ATCTTGGCTGTGCATAGGACTCCAGAGGGCGTCATCTACCCTTCCATGTGCTGGATCCGGGACTCCCTGGTCAGCTA
CATCACCAACCTGGGCCTCTTCAGCCTGGTGTTTCTGTTCAACATGGCCATGCTAGCCACCATGGTGGTGCAGATCC
TGCGGCTGCGCCCCCACACCCAAAAGTGGTCACATGTGCTGACACTGCTGGGCCTCAGCCTGGTCCTTGGCCTGCCC
TGGGCCTTGATCTTCTTCTCCTTTGCTTCTGGCACCTTCCAGCTTGTCGTCCTCTACCTTTTCAGCATCATCACCTC
CTTCCAAGGCTTCCTCATCTTCATCTGGTACTGGTCCATGCGGCTGCAGGCCCGGGGTGGCCCCTCCCCTCTGAAGA
GCAACTCAGACAGCGCCAGGCTCCCCATCAGCTCGGGCAGCACCTCGTCCAGCCGCATCTAGGCCTCCAGCCCACCT
GCCCATGTGATGAAGCAGAGATGCGGCCTCGTCGCACACTGCCTGTGGCCCCCGAGCCAGGCCCAGCCCCAGGCCAG
TCAGCCGCAGACTTTGGAAAGCCCAACGACCATGGAGAGATGGGCCGTTGCCATGGTGGACGGACTCCCGGGCTGGG
CTTTTGAATTGGCCTTGGGGACTACTCGGCTCTCACTCAGCTCCCACGGGACTCAGAAGTGCGCCGCCATGCTGCCT
AGGGTACTGTCCCCACATCTGTCCCAACCCAGCTGGAGGCCTGGTCTCTCCTTACAACCCCTGGGCCCAGCCCTCAT
TGCTGGGGGCCAGGCCTTGGATCTTGAGGGTCTGGCACATCCTTAATCCTGTGCCCCTGCCTGGGACAGAAATGTGG
CTCCAGTTGCTCTGTCTCTCGTGGTCACCCTGAGGGCACTCTGCATCCTCTGTCATTTTAACCTCAGGTGGCACCCA
GGGCGAATGGGGCCCAGGGCAGACCTTCAGGGCCAGAGCCCTGGCGGAGGAGAGGCCCTTTGCCAGGAGCACAGCAG
CAGCTCGCCTACCTCTGAGCCCAGGCCCCCTCCCTCCCTCAGCCCCCCAGTCCTCCCTCCATCTTCCCTGGGGTTCT
CCTCCTCTCCCAGGGCCTCCTTGCTCCTTCGTTCACAGCTGGGGGTCCCCGATTCCAATGCTGTTTTTGGGGAGTG
GTTTCCAGGAGCTGCCTGGTGTCTGCTGTAAATGTTTGTCTACTGCACAAGCCTCGGCCTGCCCCTGAGCCAGGCTC
GGTACCGATGCGTGGGCTGGGCTAGGTCCCTCTGTCCATCTGGGCCTTTGTATGAGCTGCATTGCCCTTGCTCACCC
TGACCAAGCACACGCCTCAGAGGGGCCCTCAGCCTCTCCTGAAGCCCTCTTGTGGCAAGAACTGTGGACCATGCCAG
TCCCGTCTGGTTTCCATCCCACCACTCCAAGGACTGAGACTGACCTCCTCTGGTGACACTGGCCTAGAGCCTGACAC
TCTCCTAAGAGGTTCTCTCCAAGCCCCCAAATAGCTCCAGGCGCCCTCGGCCGCCCATCATGGTTAATTCTGTCCAA
CAAACACACACGGGTAGATTGCTGGCCTGTTGTAGGTGGTAGGGACACAGATGACCGACCTGGTCACTCCTCCTGCC
AACATTCAGTCTGGTATGTGAGGCGTGCGTGAAGCAAGAACTCCTGGAGCTACAGGGACAGGGAGCCATCATTCCTG
CCTGGGAATCCTGGAAGACTTCCTGCAGGAGTCAGCGTTCAATCTTGACCTTGAAGATGGAAGGATGTTCTTTTTA
CGTACCAATTCTTTTGTCTTTTGATATTAAAAAGAAGTACATGTTCATTGTAGAGAATTTGGAAACTGTAGAAGAGA
ATCAAGAAGAAAAATAAAAATCAGCTGTTGTAATCGCCTAGCAAAAAAAAAAAAAAAAAAAAAAAAAAAA
AAAAAAAAAAAAAAAAAAAAAAAAAAAAAAAAAAAAAAAAA

FIGURE 95

CGGAGAGCGCGCTCTGCCTGCCGCCTGCCTGCCTGCCACTGAGGGTTCCCAGCACCATGAGGGCCTGGATCTTCTTT
CTCCTTTGCCTGGCCGGGAGGGCCTTGGCAGCCCCTCAGCAAGAAGCCCTGCCTGATGAGACAGAGGTGGTGGAAGA
AACTGTGGCAGAGGTGACTGAGGTATCTGTGGGAGCTAATCCTGTCCAGGTGGAAGTAGGAGAATTTGATGATGGTG
CAGAGGAAACCGAAGAGGAGGTGGTGGCGGAAAATCCCTGCCAGAACCACCACTGCAAACACGGCAAGGTGTGCGAG
CTGGATGAGAACAACACCCCCATGTGCGTGTGCCAGGACCCCACCAGCTGCCCAGCCCCCATTGGCGAGTTTGAGAA
GGTGTGCAGCAATGACAACAAGACCTTCGACTCTTCCTGCCACTTCTTTGCCACAAAGTGCACCCTGGAGGGCACCA
AGAAGGGCCACAAGCTCCACCTGGACTACATCGGGCCTTGCAAATACATCCCCCCTTGCCTGGACTCTGAGCTGACC
GAATTCCCCCTGCGCATGCGGGACTGGCTCAAGAACGTCCTGGTCACCCTGTATGAGAGGGATGAGGACAACAACCT
TCTGACTGAGAAGCAGAAGCTGCGGGTGAAGAAGATCCATGAGAATGAGAAGCGCCTGGAGGCAGGAGACCACCCCG
TGGAGCTGCTGGCCCGGGACTTCGAGAAGAACTATAACATGTACATCTTCCCTGTACACTGGCAGTTCGGCCAGCTG
GACCAGCACCCCATTGACGGGTACCTCTCCCACACCGAGCTGGCTCCACTGCGTGCTCCCCTCATCCCCATGGAGCA
TTGCACCACCCGCTTTTTCGAGACCTGTGACCTGGACAATGACAAGTACATCGCCCTGGATGAGTGGGCCGGCTGCT
TCGGCATCAAGCAGAAGGATATCGACAAGGATCTTGTGATCTAAATCCACTCCTTCCACAGTACCGGATTCTCTCTT
TAACCCTCCCCTTCGTGTTTCCCCCAATGTTTAAAATGTTTGGATGGTTTGTTGTTCTGCCTGGAGACAAGGTGCTA
ACATAGATTTAAGTGAATACATTAACGGTGCTAAAAATGAAAATTCTAACCCAAGACATGACATTCTTAGCTGTAAC
TTAACTATTAAGGCCTTTTCCACACGCATTAATAGTCCCATTTTTCTCTTGCCATTTGTAGCTTTGCCCATTGTCTT
ATTGGCACATGGGTGGACACGGATCTGCTGGGCTCTGCCTTAAACACACATTGCAGCTTCAACTTTTCTCTTTAGTG
TTCTGTTTGAAACTAATACTTACCGAGTCAGACTTTGTGTTCATTTCATTTCAGGGTCTTGGCTGCCTGTGGGCTTC
CCCAGGTGGCCTGGAGGTGGGCAAAGGGAAGTAACAGACACACGATGTTGTCAAGGATGGTTTTGGGACTAGAGGCT
CAGTGGTGGGAGAGATCCCTGCAGAACCCACCAACCAGAACGTGGTTTGCCTGAGGCTGTAACTGAGAGAAAGATTC
TGGGGCTGTGTTATGAAAATATAGACATTCTCACATAAGCCCAGTTCATCACCATTTCCTCCTTTACCTTTCAGTGC
AGTTTCTTTTCACATTAGGCTGTTGGTTCAAACTTTTGGGAGCACGGACTGTCAGTTCTCTGGGAAGTGGTCAGCGC
ATCCTGCAGGGCTTCTCCTCCTCTGTCTTTTGGAGAACCAGGGCTCTTCTCAGGGGCTCTAGGGACTGCCAGGCTGT
TTCAGCCAGGAAGGCCAAAATCAAGAGTGAGATGTAGAAAGTTGTAAAATAGAAAAAGTGGAGTTGGTGAATCGGTT
GTTCTTTCCTCACATTTGGATGATTGTCATAAGGTTTTTAGCATGTTCCTCCTTTTCTTCACCCTCCCCTTTTTTCT
TCTATTAATCAAGAGAAACTTCAAAGTTAATGGATGGTCGGATCTCACAGGCTGAGAACTCGTTCACCTCCAAGCA
TTTCATGAAAAAGCTGCTTCTTATTAATCATACAAACTCTCACCATGATGTGAAGAGTTTCACAAATCCTTCAAAAT
AAAAAGTAATGACTTAAAAAAAAAAAAAAAAAAAAAAAAAAAAAAAAAAAAA

FIGURE 96

GAATTCTTAGTTGTTTTCTTTAGAAGAACATTTCTAGGGAATAATACAAGAAGATTTAGGAATCATTGAAGTTATAA
ATCTTTGGAATGAGCAAACTCAGAATGGTGCTACTTGAAGACTCTGGATCTGCTGACTTCAGAAGACATTTTGTCAA
CCTGAGTCCCTTCACCATTACTGTGGTCTTACTTCTCAGTGCCTGTTTTGTCACCAGTTCTCTTGGAGGAACAGACA
AGGAGCTGAGGCTAGTGGATGGTGAAAACAAGTGTAGCGGGAGAGTGGAAGTGAAAGTCCAGGAGGAGTGGGGAACG
GTGTGTAATAATGGCTGGAGCATGGAAGCGGTCTCTGTGATTTGTAACCAGCTGGGATGTCCAACTGCTATCAAAGC
CCCTGGATGGGCTAATTCCAGTGCAGGTTCTGGACGCATTTGGATGGATCATGTTTCTTGTCGTGGGAATGAGTCAG
CTCTTTGGGATTGCAAACATGATGGATGGGGAAAGCATAGTAACTGTACTCACCAACAAGATGCTGGAGTGACCTGC
TCAGATGGATCCAATTTGGAAATGAGGCTGACGCGTGGAGGGAATATGTGTTCTGGAAGAATAGAGATCAAATTCCA
AGGACGGTGGGGAACAGTGTGTGATGATAACTTCAACATAGATCATGCATCTGTCATTTGTAGACAACTTGAATGTG
GAAGTGCTGTCAGTTTCTCTGGTTCATCTAATTTTGGAGAAGGCTCTGGACCAATCTGGTTTGATGATCTTATATGC
AACGGAAATGAGTCAGCTCTCTGGAACTGCAAACATCAAGGATGGGGAAAGCATAACTGTGATCATGCTGAGGATGC
TGGAGTGATTTGCTCAAAGGGAGCAGATCTGAGCCTGAGACTGGTAGATGGAGTCACTGAATGTTCAGGAAGATTAG
AAGTGAGATTCCAAGGAGAATGGGGGACAATATGTGATGACGGCTGGGACAGTTACGATGCTGCTGTGGCATGCAAG
CAACTGGGATGTCCAACTGCCGTCACAGCCATTGGTCGAGTTAACGCCAGTAAGGATTTGGACACATCTGGCTTGA
CAGCGTTTCTTGCCAGGGACATGAACCTGCTGTCTGGCAATGTAAACACCATGAATGGGGAAAGCATTATTGCAATC
ACAATGAAGATGCTGGCGTGACATGTTCTGATGGATCAGATCTGGAGCTAAGACTTAGAGGTGGAGGCAGCCGCTGT
GCTGGGACAGTTGAGGTGGAGATTCAGAGACTGTTAGGGAAGGTGTGTGACAGAGGCTGGGGACTGAAAGAAGCTGA
TGTGGTTTGCAGGCAGCTGGGATGTGGATCTGCACTCAAAACATCTTATCAAGTGTACTCCAAAATCCAGGCAACAA
ACACATGGCTGTTTCTAAGTAGCTGTAACGGAAATGAAACTTCTCTTTGGGACTGCAAGAACTGGCAATGGGGTGGA
CTTACCTGTGATCACTATGAAGAAGCCAAAATTACCTGCTCAGCCCACAGGGAACCCAGACTGGTTGGAGGGGACAT
TCCCTGTTCTGGACGTGTTGAAGTGAAGCATGGTGACACGTGGGGCTCCATCTGTGATTCGGACTTCTCTCTGGAAG
CTGCCAGCGTTCTATGCAGGGAATTACAGTGTGGCACAGTTGTCTCTATCCTGGGGGGAGCTCACTTTGGAGAGGGA
AATGGACAGATCTGGGCTGAAGAATTCCAGTGTGAGGGACATGAGTCCCATCTTTCACTCTGCCCAGTAGCACCCCG
CCCAGAAGGAACTTGTAGCCACAGCAGGGATGTTGGAGTAGTCTGCTCAAGATACACAGAAATTCGCTTGGTGAATG
GCAAGACCCCGTGTGAGGGCAGAGTGGAGCTCAAAACGCTTGGTGCCTGGGGATCCCTCTGTAACTCTCACTGGGAC
ATAGAAGATGCCCATGTTCTTTGCCAGCAGCTTAAATGTGGAGTTGCCCTTTCTACCCCAGGAGGAGCACGTTTTGG
AAAAGGAAATGGTCAGATCTGGAGGCATATGTTTCACTGCACTGGGACTGAGCAGCACATGGGAGATTGTCCTGTAA
CTGCTCTAGGTGCTTCATTATGTCCTTCAGAGCAAGTGGCCTCTGTAATCTGCTCAGGAAACCAGTCCCAAACACTG
TCCTCGTGCAATTCATCGTCTTTGGGCCCAACAAGGCCTACCATTCCAGAAGAAAGTGCTGTGGCCTGCATAGAGAG
TGGTCAACTTCGCCTGGTAAATGGAGGAGGTCGCTGTGCTGGGAGAGTAGAGATCTATCATGAGGGCTCCTGGGGCA
CCATCTGTGATGACAGCTGGGACCTGAGTGATGCCCACGTGGTTTGCAGACAGCTGGGCTGTGGAGAGGCCATTAAT
GCCACTGGTTCTGCTCATTTTGGGGAAGGAACAGGGCCCATCTGGCTGGATGAGATGAAATGCAATGGAAAAGAATC
CCGCATTTGGCAGTGCCATTCACACGGCTGGGGGCAGCAAAATTGCAGGCACAAGGAGGATGCGGGAGTTATCTGCT
CAGAATTCATGTCTCTGAGACTGACCAGTGAAGCCAGCAGAGAGGCCTGTGCAGGGCGTCTGGAAGTTTTTTACAAT
GGAGCTTGGGGCACTGTTGGCAAGAGTAGCATGTCTGAAACCACTGTGGGTGTGGTGTGCAGGCAGCTGGGCTGTGC
AGACAAAGGGAAAATCAACCCTGCATCTTTAGACAAGGCCATGTCCATTCCCATGTGGGTGGACAATGTTCAGTGTC
CAAAAGGACCTGACACGCTGTGGCAGTGCCCATCATCTCCATGGGAGAAGAGACTGGCCAGCCCCTCGGAGGAGACC
TGGATCACATGTGACAACAAGATAAGACTTCAGGAAGGACCCACTTCCTGTTCTGGACGTGTGGAGATCTGGCATGG
AGGTTCCTGGGGGACAGTGTGTGATGACTCTTGGGACTTGGACGATGCTCAGGTGGTGTGTCAACAACTTGGCTGTG
GTCCAGCTTTGAAAGCATTCAAAGAAGCAGAGTTTGGTCAGGGGACTGGACCGATATGGCTCAATGAAGTGAAGTGC
AAAGGGAATGAGTCTTCCTTGTGGGATTGTCCTGCCAGACGCTGGGGCCATAGTGAGTGTGGGCACAAGGAAGACGC
TGCAGTGAATTGCACAGATATTTCAGTGCAGAAAACCCCACAAAAAGCCACAACAGGTCGCTCATCCCGTCAGTCAT
CCTTTATTGCAGTCGGGATCCTTGGGGTTGTTCTGTTGGCCATTTTCGTCGCATTATTCTTCTTGACTAAAAAGCGA
AGACAGAGACAGCGGCTTGCAGTTTCCTCAAGAGGAGAGAACTTAGTCCACCAAATTCAATACCGGGAGATGAATTC
TTGCCTGAATGCAGATGATCTGGACCTAATGAATTCCTCAGGAGGCCATTCTGAGCCACACTGAAAAGGAAAATGGG
AATTTATAACCCAGTGAGTTCAGCCTTTAAGATACCTTGATGAAGACCTGGACTATTGAATGGAGCAGAAATTCACC
TCTCTCACTGACTATTACAGTTGCATTTTTATGGAGTTCTTCTTCTCCTAGGATTCCTAAGACTGCTGCTGAATTTA
TAAAAATTAAGTTTGTGAATGTGACTACTTAGTGGTGTATATGAGACTTTCAAGGGAATTAAATAAATAAATAAGAA
TGTTAAA

FIGURE 97

MAQLFLPLLAALVLAQAPAALADVLEGDSSEDRAFRVRIAGDAPLQGVLGGALTIPCHVHYLRPPPSRRAVLGSPRV
KWTFLSRGREAEVLVARGVRVKVNEAYRFRVALPAYPASLTDVSLALSELRPNDSGIYRCEVQHGIDDSSDAVEVKV
KGVVFLYREGSARYAFSFSGAQEACARIGAHIATPEQLYAAYLGGYEQCDAGWLSDQTVRYPIQTPREACYGDMDGF
PGVRNYGVVDPDDLYDVYCYAEDLNGELFLGDPPEKLTLEEARAYCQERGAEIATTGQLYAAWDGGLDHCSPGWLAD
GSVRYPIVTPSQRCGGGLPGVKTLFLFPNQTGFPNKHSRFNVYCFRDSAQPSAIPEASNPASNPASDGLEAIVTVTE
TLEELQLPQEATESESRGAIYSIPIMEDGGGGSSTPEDPAEAPRTLLEFETQSMVPPTGFSEEEGKALEEEEKYEDE
EEKEEEEEEEEVEDEALWAWPSELSSPGPEASLPTEPAAQEESLSQAPARAVLQPGASPLPDGESEASRPPRVHGPP
TETLPTPRERNLASPSPSTLVEAREVGEATGGPELSGVPRGESEETGSSEGAPSLLPATRAPEGTRELEAPSEDNSG
RTAPAGTSVQAQPVLPTDSASRGGVAVVPASGNSAQGSTALSILLLFFPLQLWVT

Signal sequence.
amino acids 1-15

Transmembrane domain.
amino acids 652-670

N-glycosylation sites.
amino acids 130-133, 337-340

Tyrosine kinase phosphorylation sites.
amino acids 128-135, 451-459

N-myristoylation sites.
amino acids 47-52, 50-55, 133-138, 142-147, 174-179, 183-188, 281-286, 288-293, 297-302, 324-329, 403-408, 414-419, 415-420, 576-581, 586-591

Immunoglobulins and major histocompatibility complex.
amino acids 135-141

Extracellular link domain.
amino acids 156-251, 257-353

Immunoglobulin domain.
amino acids 50-139

FIGURE 98

MPGAAAAAAAAAAAMLPAQEAAKLYHTNYVRNSRAIGVLWAIFTICFAIVNVVCFIQPYWIGDGVDTPQAGYFGLFH
YCIGNGFSRELTCRGSFTDFSTLPSGAFKAASFFIGLSMMLIIACIICFTLFFFCNTATVYKICAWMQLTSAACLVL
GCMIFPDGWDSDEVKRMCGEKTDKYTLGACSVRWAYILAIIGILDALILSFLAFVLGNRQDSLMAEELKAENKVLLS
QYSLE

Transmembrane domains.
amino acids 1-15, 34-54, 107-127, 141-161, 187-207

N-myristoylation sites.
amino acids 3-8, 37-42, 81-86, 103-108, 196-201

FIGURE 99

MGSCSGRCALVVLCAFQLVAALERQVFDFLGYQWAPILANFVHIIIVILGLFGTIQYRLRYVMVYTLWAAVWVTWNV
FIICFYLEVGGLLKDSELLTFSLSRHRSWWRERWPGCLHEEVPAVGLGAPHGQALVSGAGCALEPSYVEALHSCLQI
LIALLGFVCGCQVVSVFTEEEDSFDFIGGFDPFPLYHVNEKPSSLLSKQVYLPA

Signal sequence.
amino acids 1-21

Transmembrane domains.
amino acids 34-54, 74-94, 147-167

Glycosaminoglycan attachment site.
amino acids 134-137

Tyrosine kinase phosphorylation site.
amino acids 24-33

N-myristoylation sites.
amino acids 2-7, 50-55, 125-130, 135-140

FIGURE 100

MGSRCALALAVLSALLCQVWSSGVFELKLQEFVNKKGLLGNRNCCRGGAGPPPCACRTFFRVCLKHYQASVSPEPPC
TYGSAVTPVLGVDSFSLPDGGGADSAFSNPIRFPFGFTWPGTFSLIIEALHTDSPDDLATENPERLISRLATQRHLT
VGEEWSQDLHSSGRTDLKYSYRFVCDEHYYGEGCSVFCRPRDDAFGHFTCGERGEKVCNPGWKGPYCTEPICLPGCD
EQHGFCDKPGECKCRVGWQGRYCDECIRYPGCLHGTCQQPWQCNCQEGWGGLFCNQDLNYCTHHKPCKNGATCTNTG
QGSYTCSCRPGYTGATCELGIDECDPSPCKNGGSCTDLENSYSCTCPPGFYGKICELSAMTCADGPCFNGGRCSDSP
DGGYSCRCPVGYSGFNCEKKIDYCSSSPCSNGAKCVDLGDAYLCRCQAGFSGRHCDDNVDDCASSPCANGGTCRDGV
NDFSCTCPPGYTGRNCSAPVSRCEHAPCHNGATCHERGHRYVCECARGYGGPNCQFLLPELPPGPAVVDLTEKLEGQ
GGPFPWVAVCAGVILVLMLLLGCAAVVVCVRLRLQKHRPPADPCRGETETMNNLANCQREKDISVSIIGATQIKNTN
KKADFHGDHSADKNGFKARYPAVDYNLVQDLKGDDTAVRDAHSKRDTKCQPQGSSGEEKGTPTTLRGGEASERKRPD
SGCSTSKDTKYQSVYVISEEKDECVIATEV

Signal sequence.
amino acids 1-21

Transmembrane domain.
amino acids 546-566

N-glycosylation site.
amino acids 477-481 cAMP- and cGMP-dependent protein kinase phosphorylation site.
amino acids 660-664

Tyrosine kinase phosphorylation sites.
amino acids 176-185, 252-261

N-myristoylation sites.
amino acids 2-8, 37-43, 40-46, 98-104, 99-105, 262-268, 281-287, 282-288, 301-307, 310-316, 328-334, 340-344, 378-384, 387-393, 512-518, 676-682, 683-689, 695-701

Aspartic acid and asparagine hydroxylation sites.
amino acids 343-355, 420-432, 458-470

Prokaryotic membrane lipoprotein lipid attachment site.
amino acids 552-563

EGF-like domain cysteine pattern signature.
amino acids 243-255, 274-286, 314-326, 352-364, 391-403, 429-441, 467-479, 505-517

FIGURE 101A

MRILKRFLACIQLLCVCRLDWANGYYRQQRKLVEEIGWSYTGALNQKNWGKKYPTCNSPKQSPINIDEDLTQVNVNL
KKLKFQGWDKTSLENTFIHNTGKTVEINLTNDYRVSGGVSEMVFKASKITFHWGKCNMSSDGSEHSLEGQKFPLEMQ
IYCFDADRFSSFEEAVKGKGKLRALSILFEVGTEENLDFKAIIDGVESVSRFGKQAALDPFILLNLLPNSTDKYYIY
NGSLTSPPCTDTVDWIVFKDTVSISESQLAVFCEVLTMQQSGYVMLMDYLQNNFREQQYKFSRQVFSSYTGKEEIHE
AVCSSEPENVQADPENYTSLLVTWERPRVVYDTMIEKFAVLYQQLDGEDQTKHEFLTDGYQDLGAILNNLLPNMSYV
LQIVAICTNGLYGKYSDQLIVDMPTDNPELDLFPELIGTEEIIKEEEEGKDIEEGAIVNPGRDSATNQIRKKEPQIS
TTTHYNRIGTKYNEAKTNRSPTRGSEFSGKGDVPNTSLNSTSQPVTKLATEKDISLTSQTVTELPPHTVEGTSASLN
DGSKTVLRSPHMNLSGTAESLNTVSITEYEEESLLTSFKLDTGAEDSSGSSPATSAIPFISENISQGYIFSSENPET
ITYDVLIPESARNASEDSTSSGSEESLKDPSMEGNVWFPSSTDITAQPDVGSGRESFLQTNYTEIRVDESEKTTKSF
SAGPVMSQGPSVTDLEMPHYSTFAYFPTEVTPHAFTPSSRQQDLVSTVNVVYSQTTQPVYNGETPLQPSYSSEVFPL
VTPLLLDNQILNTTPAASSSDSALHATPVFPSVDVSFESILSSYDGAPLLPFSSASFSSELFRHLHTVSQILPQVTS
ATESDKVPLHASLPVAGGDLLLEPSLAQYSDVLSTTHAASETLEFGSESGVLYKTLMFSQVEPPSSDAMMHARSSGP
EPSYALSDNEGSQHIFTVSYSSAIPVHDSVGVTYQGSLFSGPSHIPIPKSSLITPTASLLQPTHALSGDGEWSGASS
DSEFLLPDTDGLTALNISSPVSVAEFTYTTSVFGDDNKALSKSEIIYGNETELQIPSFNEMVYPSESTVMPNMYDNV
NKLNASLQETSVSISSTKGMFPGSLAHTTTKVFDHEISQVPENNFSVQPTHTVSQASGDTSLKPVLSANSEPASSDP
ASSEMLSPSTQLLFYETSASFSTEVLLQPSFQASDVDTLLKTVLPAVPSDPILVETPKVDKISSTMLHLIVSNSASS
ENMLHSTSVPVFDVSPTSHMHSASLQGLTISYASEKYEPVLLKSESSHQVVPSLYSNDELFQTANLEINQAHPPKGR
HVFATPVLSIDEPLNTLINKLIHSDEILTSTKSSVTGKVFAGIPTVASDTFVSTDHSVPIGNGHVAITAVSPHRDGS
VTSTKLLFPSKATSELSHSAKSDAGLVGGGEDGDTDDDGDDDDDRDSDGLSIHKCMSCSSYRESQEKVMNDSDTHEN
SLMDQNNPISYSLSENSEEDNRVTSVSSDSQTGMDRSPGKSPSANGLSQKHNDGKEENDIQTGSALLPLSPESKAWA
VLTSDEESGSGQGTSDSLNENETSTDFSFADTNEKDADGILAAGDSEITPGFPQSPTSSVTSENSEVFHVSEAEASN
SSHESRIGLAEGLESEKKAVIPLVIVSALTFICLVVLVGILIYWRKCFQTAHFYLEDSTSPRVISTPPTPIFPISDD
VGAIPIKHFPKHVADLHASSGFTEEFETLKEFYQEVQSCTVDLGITADSSNHPDNKHKNRYINIVAYDHSRVKLAQL
AEKDGKLTDYINANYVDGYNRPKAYIAAQGPLKSTAEDFWRMIWEHNVEVIVMITNLVEKGRRKCDQYWPADGSEEY
GNFLVTQKSVQVLAYYTVRNFTLRNTKIKKGSQKGRPSGRVVTQYHYTQWPDMGVPEYSLPVLTFVRKAAYAKRHAV
GPVVVHCSAGVGRTGTYIVLDSMLQQIQHEGTVNIFGFLKHIRSQRNYLVQTEEQYVFIHDTLVEAILSKETEVLDS
HIHAYVNALLIPGPAGKTKLEKQFQLLSQSNIQQSDYSAALKQCNREKNRTSSIIPVERSRVGISSLSGEGTDYINA
SYIMGYYQSNEFIITQHPLLHTIKDFWRMIWDHNAQLVVMIPDGQNMAEDEFVYWPNKDEPINCESFKVTLMAEEHK
CLSNEEKLIIQDFILEATQDDYVLEVRHFQCPKWPNPDSPISKTFELISVIKEEAANRDGPMIVHDEHGGVTAGTFC
ALTTLMHQLEKENSVDVYQVAKMINLMRPGVFADIEQYQFLYKVILSLVSTRQEENPSTSLDSNGAALPDGNIAESL
ESLV

Signal sequence.
amino acids 1-19
Transmembrane domain.
amino acids 1638-1658
N-glycosylation sites.
amino acids 105-108, 134-137, 223-226, 232-235, 324-327, 381-384, 497-500, 501-504, 552-555, 602-605, 629-632, 677-680, 1017-1020, 1050-1053, 1082-1085, 1122-1125, 1456-1459, 1561-1564, 1617-1620, 1868-1871, 2051-2054, 2078-2081
Glycosaminoglycan attachment sites.
amino acids 490-493, 991-994, 1548-1551, 1550-1553, 2070-2073
cAMP- and cGMP-dependent protein kinase phosphorylation site.
amino acids 1877-1880
Tyrosine kinase phosphorylation site.
amino acids 148-156
N-myristoylation sites.
amino acids 139-144, 186-191, 372-377, 471-476, 486-491, 533-538, 555-560, 582-587, 588-593, 638-643, 893-898, 960-965, 1097-1102, 1259-1264, 1385-1390, 1411-1416, 1415-1420, 1549-1554, 1551-1556, 1553-1558, 1579-1584, 1625-1630, 1879-1884, 1935-1940, 2123-2128, 2225-2230, 2226-2231, 2230-2235
Amidation sites.
amino acids 49-52, 1831-1834
Tyrosine specific protein phosphatases active site.
amino acids 1930-1942
Protein-tyrosine phosphatase.
amino acids 1749-1990, 2047-2280
Eukaryotic-type carbonic anhydrase.
amino acids 38-300
Fibronectin type III domain.
amino acids 312-401

FIGURE 101B

MAM domain proteins.
amino acids 1757-1785, 1060-1088, 1813-1853, 2047-2079

FIGURE 102

MALKNINYLLIFYLSFSLLIYIKNSFCNKNNTRCLSNSCQNNSTCKDFSKDNDCSCSDTANNLDKDCDNMKDPCFSN
PCQGSATCVNTPGERSFLCKCPPGYSGTICETTIGSCGKNSCQHGGICHQDPIYPVCICPAGYAGRFCEIDHDECAS
SPCQNGAVCQDGIDGYSCFCVPGYQGRHCDLEVDECASDPCKNEATCLNEIGRYTCICPHNYSGVNCELEIDECWSQ
PCLNGATCQDALGAYFCDCAPGFLGDHCELNTDECASQPCLHGGLCVDGENRYSCNCTGSGFTGTHCETLMPLCWSK
PCHNNATCEDSVDNYTCHCWPGYTGAQCEIDLNECNSNPCQSNGECVELSSEKQYGRITGLPSSFSYHEASGYVCIC
QPGFTGIHCEEDVNECSSNPCQNGGTCENLPGNYTCHCPFDNLSRTFYGGRDCSDILLGCTHQQCLNNGTCIPHFQD
GQHGFSCLCPSGYTGSLCEIATTLSFEGDGFLWVKSGSVTTKGSVCNIALRFQTVQPMALLLFRSNRDVFVKLELLS
GYIHLSIQVNNQSKVLLFISHNTSDGEWHFVEVIFAEAVTLTLIDDSCKEKCIAKAPTPLESDQSICAFQNSFLGGL
PVGMTSNGVALLNFYNMPSTPSFVGCLQDIKIDWNHITLENISSGSSLNVKAGCVRKDWCESQPCQSRGRCINLWLS
YQCDCHRPYEGPNCLREYVAGRFGQDDSTGYVIFTLDESYGDTISLSMFVRTLQPSGLLLALENSTYQYIRVWLERG
RLAMLTPNSPKLVVKFVLNDGNVHLISLKIKPYKIELYQSSQNLGFISASTWKIEKGDVIYIGGLPDKQETELNGGF
FKGCIQDVRLNNQNLEFFPNPTNNASLNPVLVNVTQGCAGDNSCKSNPCHNGGVCHSRWDDFSCSCPALTSGKACEE
VQWCGFSPCPHGAQCQPVLQGFECIANAVFNGQSGQILFRSNGNITRELTNITFGFRTRDANVIILHAEKEPEFLNI
SIQDSRLFFQLQSGNSFYMLSLTSLQSVNDGTWHEVTLSMTDPLSQTSRWQMEVDNETPFVTSTIATGSLNFLKDNT
DIYVGDRAIDNIKGLQGCLSTIEIGGIYLSYFENVHGFINKPQEEQFLKISTNSVVTGCLQLNVCNSNPCLHGGNCE
DIYSSYHCSCPLGWSGKHCELNIDECFSNPCIHGNCSDRVAAYHCTCEPGYTGVNCEVDIDNCQSHQCANGATCISH
TNGYSCLCFGNFTGKFCRQSRLPSTVCGNEKTNLTCYNGGNCTEFQTELKCMCRPGFTGEWCEKDIDECASDPCVNG
GLCQDLLNKFQCLCDVAFAGERCEVDVSSLSFYVSLLFWQNLFQLLSYLILRMNDEPVVEWGEQEDY

Transmebrane domain.

amino acids 1337-1357

N-glycosylation sites.

amino acids 30-33, 41-44, 42-45, 215-218, 287-290, 313-316, 322-325, 418-421, 427-430, 453-456, 550-553, 561-564, 657-660, 757-760, 871-874, 880-883, 968-971, 975-978, 1000-1003, 1190-1193, 1243-1246, 1265-1268, 1273-1276

N-myristoylation sites.

amino acids 81-86, 244-249, 290-295, 368-373, 410-415, 417-422, 434-439, 499-504, 505-510, 615-620, 619-624, 661-666, 717-722, 750-755, 900-905, 1092-1097, 1095-1100, 1104-1109, 1242-1247, 1260-1265, 1271-1276

Aspartic acid and asparagine hydroxylation sites.

amino acids 163-174, 201-212, 239-250, 277-288, 316-327, 412-423, 687-698, 1154-1165, 1191-1202, 1312-1323

EGF-like domain cysteine pattern signature.

amino acids 96-107, 134-145, 172-183, 210-221, 248-249, 325-336, 383-384, 469-470, 696-707, 911-922, 1163-1174, 1200-1211, 1238-1249, 1283-1294, 1321-1332

C-type lectin domain signature.

amino acids 1240-1268

EGF-like domains.

amino acids 34-67, 74-107, 114-145, 152-183, 190-221, 228-259, 266-298, 305-336, 343-394, 401-438, 445-480, 676-707, 891-922, 1143-1174, 1181-1211, 1218-1249, 1259-1294, 1301-1332

Laminin G domains.

amino acids 514-654, 743-863, 980-1108

FIGURE 103

MLPARCARLLTPHLLLVLVQLSPARGHRTTGPRFLISDRDPQCNLHCSRTQPKPICASDGRSYESMCEYQRAKCRDP
TLGVVHRGRCKDAGQSKCRLERAQALEQAKKPQEAVFVPECGEDGSFTQVQCHTYTGYCWCVTPDGKPISGSSVQNK
TPVCSGSVTDKPLSQGNSGRKDDGSKPTPTMETQPVFDGDEITAPTLWIKHLVIKDSKLNNTNIRNSEKVYSCDQER
QSALEEAQQNPREGIVIPECAPGGLYKPVQCHQSTGYCWCVLVDTGRPLPGTSTRYVMPSCESDARAKTTEADDPFK
DRELPGCPEGKKMEFITSLLDALTTDMVQAINSAAPTGGGRFSEPDPSHTLEERVVHWYFSQLDSNSSNDINKREMK
PFKRYVKKKAKPKKCARRFTDYCDLNKDKVISLPELKGCLGVSKEGRLV

Signal sequence.
amino acids 1-26

N-glycosylation sites.
amino acids 214-217, 374-377 cAMP- and cGMP-dependent protein kinase phosphorylation site.
amino acids 402-405

Tyrosine kinase phosphorylation site.
amino acids 219-325

N-myristoylation sites.
amino acids 91-96, 314-319, 347-352

Amidation sites.
amino acids 172-175, 317-320

Kazal-type serine protease inhibitor.
amino acids 43-87

Thyroglobulin type-1 repeat.
amino acids 95-158, 227-292

FIGURE 104

```
MDTSGHFHDSGVGDLDEDPKCPCPSSGDEQQQQQQQQQQQQQPPPPAPPAAPQQPLGPSLQPQPPQLQQQQQQQQQQQ
QQQPPHPLSQLAQLQSQPVHPGLLHSSPTAFRAPPSSNSTAILHPSSRQGSQLNLNDHLLGHSPSSTATSGPGGGSR
HRQASPLVHRRDSNPFTEIAMSSCKYSGGVMKPLSRLSASRRNLIEAETEGQPLQLFSPSNPPEIVISSREDNHAHQ
TLLHHPNATHNHQHAGTAASSTTFPKANKRKNQNIGYKLGHRRAPFEKRKRLSDYALIFGMFGIVVMVIETELSWGL
YSKDSMFSLALKCLISLSTIILLGLIIAYHTREAQLFVIDNGADDWRIAMTYERILYISLEMLVCAIHPIPGEYKFF
WTARLAFSYTPSRAEADVDIILSIPMFLRLYLIARVMLLHSKLFTDASSRSIGALNKINFNTRFVMKTLMTICPGTV
LLVFSISLWIIAAWTVRACERYHDQQDVTSNFLGAMWLISITFLSIGYGDMVPHTYCGKGVCLLTGIMGAGCTALVV
AVVARKLELTKAEKHVHNFMMDTQLTKRIKNAAANVLRETWLIYKHTKLLKKIDHAKVRKHQRKFLQAIHQLRSVKM
EQRKLSDQANTLVDLSKMQNVMYDLITELNDRSEDLEKQIGSLESKLEHLTASFNSLPLLIADTLRQQQQQLLSAII
EARGVSVAVGTTHTPISDSPIGVSSTSFPTPYTSSSSC
```

Transmembrane domains.
amino acids 283-303, 318-338, 405-425, 453-473, 491-511, 523-543

N-glycosylation sites.
amino acids 115-118, 238-241

Glycosaminoglycan attachment sites.
amino acids 10-13, 147-150 cAMP- and cGMP-dependent protein kinase phosphorylation sites.
amino acids 164-167, 281-284, 619-622

N-myristoylation sites.
amino acids 99-104, 127-132, 247-252, 332-337, 528-533, 531-536, 657-662, 697-702, 715-720

Leucine zipper pattern.
amino acids 645-666, 652-673

Calcium-activated SK potassium channel.
amino acids 269-387

Calmodulin binding domain.
amino acids 561-637

FIGURE 105

MKVLWAALLVTFLAGCQAKVEQAVETEPEPELRQQTEWQSGQRWELALGRFWDYLRWVQTLSEQVQEELLSSQVTQE
LRALMDETMKELKAYKSELEEQLTPVAEETRARLSKELQAAQARLGADMEDVCGRLVQYRGEVQAMLGQSTEELRVR
LASHLRKLRKRLLRDADDLQKRLAVYQAGAREGAERGLSAIRERLGPLVEQGRVRAATVGSLAGQPLQERAQAWGER
LRARMEEMGSRTRDRLDEVKEQVAEVRAKLEEQAQQIRLQAEAFQARLKSWFEPLVEDMQRQWAGLVEKVQAAVGTS
AAPVPSDNH

Signal sequence.
amino acids 1-18

N-myristoylation sites.
amino acids 183-188, 187-192, 214-219

Apolipoprotein A1/A4/E family.
amino acids 2-284

FIGURE 106

MGSRARGGAAGPPLKETCCGSRSGTRASAAAAAAAGARVGATARRPRVPERPQGSPGRRPRCASPVRAPPRAAPMLD
MSEARSQPPCSPSGTASSMSHVEDSDSDAPPSPAGSEGLGRAGVAVGGARGDPAEAADERFPACIRDAVSQVLKGYD
WSLVPMPVRGGGGGALKAKPHVKRPMNAFMVWAQAARRKLADQYPHLHNAELSKTLGKLWRLLSESEKRPFVEEAER
LRVQHKKDHPDYKYQPRRRKSAKAGHSDSDSGAELGPHPGGGAVYKAEAGLGDGHHHGDHTGQTHGPPTPPTTPKTE
LQQAGAKPELKLEGRRPVDSGRQNIDFSNVDISELSSEVMGTMDAFDVHEFDQYLPLGGPAPPEPGQAYGGAYFHAG
ASPVWAHKSAPSASASPTETGPPRPHIKTEQPSPGHYGDQPRGSPDYGSCSGQSSATPAAPAGPFAGSQGDYGDLQA
SSYYGAYPGYAPGLYQYPCFHSPRRPYASPLLNGLALPPAHSPTSHWDQPVYTTLTRP

Transmembrane domain.
amino acids 21-41 cAMP- and cGMP-dependent protein kinase phosphorylation site.
amino acids 249-252

Tyrosine kinase phosphorylation site.
amino acids 238-245

N-myristoylation sites.
amino acids 20-25, 24-29, 36-41, 91-96, 115-120, 120-125, 124-129, 164-169, 165-170, 168-173, 281-286, 349-354, 374-379, 433-438, 437-442, 467-472

Amidation sites.
amino acids 56-59, 321-324

Cell attachment sequence.
amino acids 127-129

HMG (high mobility group) box.
amino acids 176-244

FIGURE 107

MYYAVSQARVNAVPGTMLRPQRPGDLQLGASLYELVGYRQPPSSSSSSTSSTSSTSSSSTTAPLLPKAAREKPEAPA
EPPGPGPGSGAHPGGSARPDAKEEQQQQLRRKINSRERKRMQDLNLAMDALREVILPYSAAHCQGAPGRKLSKIATL
LLARNYILLLGSSLQELRRALGEGAGPAAPRLLLAGLPLLAAAPGSVLLAPGAVGPPDALRPAKYLSLALDEPPCGQ
FALPGGGAGGPGLCTCAVCKFPHLVPASLGLAAVQAQFSK

Transmembrane domains.
amino acids 150-170, 184-204 cAMP- and cGMP-dependent protein kinase phosphorylation site.
amino acids 146-149

N-myristoylation sites.
amino acids 87-92, 178-183, 236-241, 243-248

Amidation site.
amino acids 144-147

Helix-loop-helix DNA-binding domain.
amino acids 106-165

FIGURE 108

LRLFGASSSNRIQIFGSEGRRTLRKLRRLSSPGAMDSDASLVSSRPSSPEPDDLFLPARSKGSSGSAFTGGTVSSST
PSDCPPELSAELRGAMGSAGAHPGDKLGGSGFKSSSSSTSSSTSSAAASSTKKDKKQMTEPELQQLRLKINSRERKR
MHDLNIAMDGLREVMPYAHGPSVRKLSKIATLLLARNYILMLTNSLEEMKRLVSEIYGGHHAGFHPSACGGLAHSAP
LPAATAHPAAAAHAAHHPAVHHPILPPAAAAAAAAAAAAAVSSASLPGSGLPSVGSIRPPHGLLKSPSAAAAAPLGG
GGGGSGASGGFQHWGGMPCPCSMCQVPPPHHHVSAMGAGSLPRLTSDAK

Transmembrane domain.
amino acids 254-274 cAMP- and cGMP-dependent protein kinase phosphorylation sites.
amino acids 27-30, 178-181

N-myristoylation sites.
amino acids 5-10, 33-38, 62-67, 65-70, 70-75, 71-76, 91-96, 94-99, 97-102, 212-217, 225-230, 307-302, 308-313, 309-314, 310-315, 311-316, 312-317, 314-319

Amidation site.
amino acids 18-21

Regulator of chromosome condensation (RCC1) signature 2.
amino acids 222-232

Helix-loop-helix DNA-binding domain.
amino acids 143-197

FIGURE 109A

MASSVAPYEQLVRQVEALKAENSHLRQELRDNSSHLSKLETETSGMKEVLKHLQGKLEQEARVLVSSGQTEVLEQLK
ALQMDITSLYNLKFQPPTLGPEPAARTPEGSPVHGSGPSKDSFGELSRATIRLLEELDRERCFLLNEIEKEEKEKLW
YYSQLQGLSKRLDELPHVETQFSMQMDLIRQQLEFEAQHIRSLMEERFGTSDEMVQRAQIRASRLEQIDKELLEAQD
RVQQTEPQALLAVKSVPVDEDPETEVPTHPEDGTPQPGNSKVEVVFWLLSMLATRDQEDTARTLLAMSSSPESCVAM
RRSGCLPLLLQILHGTEAAAGGRAGAPGAPGAKDARMRANAALHNIVFSQPDQGLARKEMRVLHVLEQIRAYCETCW
DWLQARDGGPEGGGAGSAPIPIEPQICQATCAVMKLSFDEEYRRAMNELGGLQAVAELLQVDYEMHKMTRDPLNLAL
RRYAGMTLTNLTFGDVANKATLCARRGCMEAIVAQLASDSEELHQVVSSILRNLSWRADINSKKVLREAGSVTALVQ
CVLRATKESTLKSVLSALWNLSAHSTENKAAICQVDGALGFLVSTLTYKCQSNSLAIIESGGGILRNVSSLVATRED
YRQVLRDHNCLQTLLQHLTSHSLTIVSNACGTLWNLSARSARDQELLWDLGAVGMLRNLVHSKHKMIAMGSAAALRN
LLAHRPAKHQAAATAVSPGSCVPSLYVRKQRALEAELDARHLAQALEHLEKQGPPAAEAATKKPLPPLRHLDGLAQD
YASDSGCFDDDDAPSSLAAAAATGEPASPAALSLFLGSPFLQGQALARTPPTRRGGKEAEKDTSGEAAVAAKAKAKL
ALAVARIDQLVEDISALHTSSDDSFSLSSGDPGQEAPREGRAQSCSPCRGPEGGRREAGSRAHPLLRLKAAHASLSN
DSLNSGSASDGYCPREHMLPCPLAALASRREDPRCGQPRPSRLDLDLPGCQAEPPAREATSADARVRTIKLSPTYQH
VPLLEGASRAGAEPLAGPGISPGARKQAWLPADHLSKVPEKLAAAPLSVASKALQKLAAQEGPLSLSRCSSLSSLSS
AGRPGPSEGGDLDDSDSSLEGLEEAGPSEAELDSTWRAPGATSLPVAIPAPRRNRGRGLGVEDATPSSSSENYVQET
PLVLSRCSSVSSLGSFESPSIASSIPSEPCSGQGSGTISPSELPDSPGQTMPPSRSKTPPLAPAPQGPPEATQFSLQ
WESYVKRFLDIADCRERCRLPSELDAGSVRFTVEKPDENFSCASSLSALALHEHYVQQDVELRLLPSACPERGGGAG
GAGLHFAGHRRREEGPAPTGSRPRGAADQELELLRECLGAAVPARLRKVASALVPGRRALPVPVYMLVPAPAPAQED
DSCTDSAEGTPVNFSSAASLSDETLQGPPRDQPGGPAGRQRPTGRPTSARQAMGHRHKAGGAGRSAEQSRGAGKNRA
GLELPLGRPPSAPADKDGSKPGRTRGDGALQSLCLTTPTEEAVYCFYGNDSDEEPPAAAPTPTHRRTSAIPRAFTRE
RPQGRKEAPAPSKAAPAAPPPARTQPSLIADETPPCYSLSSSASSLSEPEPSEPPAVHPRGREPAVTKDPGPGGGRD
SSPSPRAAEELLQRCISSALPRRRPPVSGLRRRKPRATRLDERPAEGSRERGEEAAGSDRASDLDSVEWRAIQEGAN
SIVTWLHQAAAATREASSESDSILSFVSGLSVGSTLQPPKHRKGRQAEGEMGSARRPEKRGAASVKTSGSPRSPAGP
EKPRGTQKTTPGVPAVLRGRTVIYVPSPAPRAQPKGTPGPRATPRKVAPPCLAQPAAPAKVPSPGQQRSRSLHRPAK
TSELATLSQPPRSATPPARLAKTPSSSSSQTSPASQPLPRKRPPVTQAAGALPGPGASPVPKTPARTLLAKQHKTQR
SPVRIPFMQRPARRGPPPLARAVPEPGPRGRAGTEAGPGARGGRLGLVRVASALSSGSESSDRSGFRRQLTFIKESP
GLRRRRSELSSAESAASAPQGASPRRGRPALPAVFLCSSRCEELRAAPRQGPAPARQRPPAARPSPGERPARRTTSE
SPSRLPVRAPAARPETVKRYASLPHISVARRPDGAVPAAPASADAARRSSDGEPRPLPRVAAPGTTWRRIRDEDVPH
ILRSTLPATALPLRGSTPEDAPAGPPPRKTSDAVVQTEEVAAPKTNSSTSPSLETREPPGAPAGGQLSLLGSDVDGP
SLAKAPISAPFVHEGLGVAVGGFPASRHGSPSRSARVPPFNYVPSPMVVAATTDSAAEKAPATASATLLE

Transmembrane domain.
amino acids 795-815

N-glycosylation sites.
amino acids 32-35, 472-475, 515-518, 559-562, 606-609, 651-654, 924-927, 1271-1274, 1399-1402, 1512-1515, 2202-2005

Glycosaminoglycan attachment sites.
amino acids 599-602, 1186-1189 cAMP- and cGMP-dependent protein kinase phosphorylation sites.
amino acids 1528-1531, 2006-2009, 2074-2077, 2126-2129, 2184-2187

Tyrosine kinase phosphorylation sites.
amino acids 147-155, 420-427

N-myristoylation sites.
amino acids 112-117, 323-328, 329-334, 336-341, 339-344, 393-398, 397-402, 398-403, 435-440, 467-472, 489-494, 532-537, 602-607, 647-652, 670-675, 686-691, 813-818, 825-830, 1007-1012, 1020-1025, 1099-1104, 1138-1143, 1187-1192, 1305-1310, 1306-1311, 1307-1312, 1312-1317, 1395-1400, 1420-1425, 1447-1452, 1457-1462, 1481-1486, 1491-1496, 1614-1619, 1674-1679, 1723-1728, 1776-1781, 1836-1841, 1964-1969, 1967-1972, 1982-1987, 2113-2118, 2216-2221, 2220-2225, 2248-2253, 2250-2255, 2254-2259

Amidation sites.
amino acids 900-903, 1364-1367, 1543-1546

Cell attachment sequence.
amino acids 1488-1490

FIGURE 109B

Leucine zipper pattern.
amino acids 1355-1376

Matrixins cysteine switch.
amino acids 957-964

Armadillo/beta-catenin-like repeat.
amino acids 301-356, 424-475, 477-518, 521-562, 564-609, 614-654, 656-696

Homeobox associated leucine zipper.
amino acids 8-53

FIGURE 110

MSYQGKKSIPHITSDRLLIKGGRIINDDQSLYADVYLEDGLIKQIGENLIVPGGVKTIEANGRMVIPGGIDVNTYLQ
KPSQGMTAADDFFQGTRAALVGGTTMIIDHVVPEPGSSLLTSFEKWHEAADTKSCCDYSLHVDITSWYDGVREELEV
LVQDKGVNSFQVYMAYKDVYQMSDSQLYEAFTFLKGLGAVILVHAENGDLIAQEQKRILEMGITGPEGHALSRPEEL
EAEAVFRAITIAGRINCPVYITKVMSKSAADIIALARKKGPLVFGEPIAASLGTDGTHYWSKNWAKAAAFVTSPPLS
PDPTTPDYLTSLLACGDLQVTGSGHCPYSTAQKAVGKDNFTLIPEGVNGIEERMTVVWDKAVATGKMDENQFVAVTS
TNAAKIFNLYPRKGRIAVGSDADVVIWDPDKLKTITAKSHKSAVEYNIFEGMECHGSPLVVISQGKIVFEDGNINVN
KGMGRFIPRKAFPEHLYQRVKIRNKVFGLQGVSRGMYDGPVYEVPATPKYATPAPSAKSSPSKHQPPPIRNLHQSNF
SLSGAQIDDNNPRRTGHRIVAPPGGRSNITSLG

N-glycosylation sites.
amino acids 347-350, 538-541, 567-570

Tyrosine kinase phosphorylation sites.
amino acids 472-479, 496-504

N-myristoylation sites.
amino acids 53-58, 69-74, 82-87, 92-97, 284-289, 493-498, 563-568

Amidation site.
amino acids 4-7

Amidohydrolase family homology.
amino acids 64-413

FIGURE 111

MFLTEDLITFNLRNFLLFQLWESSFSPGAGGFCTTLPPSFLRVDDRATSSTTDSSRAPSSPRPPGSTSHCGISTRCT
ERCLCVLPLRTSQVPDVMAPQHDQEKFHDLAYSCLGKSFSMSNQDLYGYSTSSLALGLAWLSWETKKKNVLHLVGLDSL

Signal sequence.
amino acids 1-31

Tyrosine kinase phosphorylation site.
amino acids 103-109

N-myristoylation site.
amino acids 30-35

ATP/GTP-binding site motif A (P-loop).
amino acids 108-115

FIGURE 112

MSRPGHGGLMPVNGLGFPPQNVARVVVWECLNEHSRWRPYTATVCHHIENVLKEDARGSVVLGQVDAQLVPYIIDLQ
SMHQFRQDTGTMRPVRRNFYDPSSAPGKGIVWEWENDGGAWTAYDMDICITIQNAYEKQHPWLDLSSLGFCYLIYFN
SMSQMNRQTRRRRRLRRRLDLAYPLTVGSIPKSQSWPVGASSGQPCSCQQCLLVNSTRAVSNVILASQRRKVPPAPP
LPPPPPPGGPPGALAVRPSATFTGAALWAAPAAGPAEPAPPPGAPPRSPGAPGGARTPGQNNLNRPGPQRTTSVSAR
ASIPPGVPALPVKNLNGTGPVHPALAGMTGILLCAAGLPVCLTRAPKPILHPPPVSKSDVKPVPGVPGVCRKTKKKH
LKKSKNPEDVVRRYMQKVKNPPDEDCTICMERLVTASGYEGVLRHKGVRPELVGRLGRCGHMYHLLCLVAMYSNGNK
DGSLQCPTCKAIYGEKTGTQPPGKMEFHLIPHSLPGFPDTQTIRIVYDIPTGIQGPEHPNPGKKFTARGFPRHCYLP
NNEKGRKVLRLLITAWERRLIFTIGTSNTTGESDTVVWNEIHHKTEFGSNLTGHGYPDASYLDNVLAELTAQGVSEA
AGKA

Transmembrane domain.
amino acids 138-158

N-glycosylation sites.
amino acids 209-212, 324-327, 567-570, 589-592 cAMP- and cGMP-dependent protein kinase phosphorylation site.
amino acids 525-528

Tyrosine kinase phosphorylation sites.
amino acids 170-177, 171-177

N-myristoylation sites.
amino acids 63-68, 115-120, 116-121, 193-198, 197-202, 239-244, 281-286, 338-343, 345-350, 460-465, 564-569, 587-592, 612-617

Amidation sites.
amino acids 523-526, 543-546

Microbodies C-terminal targeting signal.
amino acids 618-621

WWE domains.
amino acids 15-94, 95-171

Zinc finger, C3HC4 type (RING finger).
amino acids 411-471

FIGURE 113

MLQTKDLIWTLFFLGTAVSLQVDIVPSQGEISVGESKFFLCQVAGDAKDKDISWFSPNGEKLTPNQQRISVVWNDDS
SSTLTIYNANIDDAGIYKCVVTGEDGSESEATVNVKIFQKLMFKNAPTPQEFREGEDAVIVCDVVSSLPPTIIWKHK
GRDVILKKDVRFIVLSNNYLQIRGIKKTDEGTYRCEGRILARGEINFKDIQVIVNVPPTIQARQNIVNATANLGQSV
TLVCDAEGFPEPTMSWTKDGEQIEQEEDDEKYIFSDDSSQLTIKKVDKNDEAEYICIAENKAGEQDATIHLKVFAKP
KITYVENQTAMELEEQVTLTCEASGDPIPSITWRTSTRNISSEEKTLDGHMVVRSHARVSSLTLKSIQYTDAGEYIC
TASNTIGQDSQSMYLEVQYAPKLQGPVAVYTWEGNQVNITCEVFAYPSATISWFRDGQLLPSSNYSNIKIYNTPSAS
YLEVTPDSENDFGNYNCTAVNRIGQESLEFILVQADTPSSPSIDQVEPYSSTAQVQFDEPEATGGVPILKYKAEWRA
VGEEVWHSKWYDAKEASMEGIVTIVGLKPETTYAVRLAALNGKGLGEISAASEFKTQPVQGEPSAPKLEGQMGEDGN
SIKVNLIKQDDGGSPIRHYLVRYRALSSEWKPEIRLPSGSDHVMLKSLDWNAEYEVYVVAENQQGKSKAAHFVFRTS
AQPTAIPANGSPTSGLSTGAIVGILIVIFVLLLVVVDITCYFLNKCGLFMCIAVNLCGKAGPGAKGKDMEEGKAAFS
KDESKEPIVEVRTEEERTPNHDGGKHTEPNETTPLTEPEKGPVEAKPECQETETKPAPAEVKTVPNDATQTKENESKA

Transmambrane domain.
amino acids 712-732

Signal sequence.
amino acids 1-19

N-glycosylation sites.
amino acids 222-225, 315-318, 347-350, 423-426, 449-452, 478-481, 800-803, 844-847

Tyrosine kinase phosphorylation sites.
amino acids 180-187, 181-187, 279-285

N-myristoylation sites.
amino acids 15-20, 92-97, 178-183, 185-190, 228-233, 419-424, 475-480, 703-708, 708-713, 712-717, 740-745, 793-798

Microbodies C-terminal targeting signal.
amino acids 846-849

ATP/GTP-binding site motif A (P-loop).
amino acids 676-683

Immunoglobulin domains.
amino acids 34-98, 132-191, 228-289, 322-387, 419-481

Fibronectin type III domains.
amino acids 500-588, 602-686

FIGURE 114

MRPVALLLLPSLLALLAHGLSLEAPTVGKGQAPGIEETDGELTAAPTPEQPERGVHFVTTAPTLKLLNHHPLLEEFL
HEGLEKGDEELRPALSFQPDPPAPFTPSPLPRLANQDSRPVFTSPTPAMAAVPTQPQSKEGPWSPDPESESPMLRIT
APLPPGPSMAVPTLGPGEIASTTPPSRAWTPTQEGPGDMGRPWVAEVVSQGAGIGIQGTITSSTASGDDEETTTTTT
IITTTITTVQTPGPCSWNFSGPEGSLDSPTDLSSPTDVGLDCFFYISVYPGYGVEIKVKNISLREGETVTVEGLGGP
DPLPLANQSFLLRGQVIRSPTHQAALRFQSLPPPAGPGTFHFHYQAYLLSCHFPRRPAYGDVTVTSLHPGGSARFHC
ATGYQLKGARHLTCLNATQPFWDSKEPVCIGECPGVIRNATTGRIVSPGFPGNYSNNLTCHWLLEAPEGQRLHLHFE
KVSLAEDDDRLIIRNGDNVEAPPVYDSYEVEYLPIEGLLSSGKHFFVELSTDSSGAAAGMALRYEAFQQGHCYEPFV
KYGNFSSSTPTYPVGTTVEFSCDPGYTLEQGSIIIECVDPHDPQWNETEPACRAVCSGEITDSAGVVLSPNWPEPYG
RGQDCIWGVHVEEDKRIMLDIRVLRIGPGDVLTFYDGDDLTARVLGQYSGPRSHFKLFTSMADVTIQFQSDPGTSVL
GYQQGFVIHFFEVPRNDTCPELPEIPNGWKSPSQPELVHGTVVTYQCYPGYQVVGSSVLMCQWDLTWSEDLPSCQRV
TSCHDPGDVEHSRRLISSPKFPVGATVQYICDQGFVLMGSSILTCHDRQAGSPKWSDRAPKCLLEQLKPCHGLSAPE
NGARSPEKQLHPAGATIHFSCAPGYVLKGQASIKCVPGHPSHWSDPPPICRAASLDGSTTVAAWMVAKAPAASSTLD
AAHIAAAIFLPLVAMVLLVGGVYFYFSRLQGKSSLQLPRPRPRPYNRITIESAFDNPTYETGSLSFAGDERI

Signal sequence.
amino acids 1-17

Transmembrane domain.
amino acids 928-948

N-glycosylation sites.
amino acids 249-252, 291-294, 315-318, 401-404, 424-427, 438-441, 442-445, 543-546, 585-588, 709-712

N-myristoylation sites.
amino acids 30-35, 34-39, 80-85, 205-210, 209-214, 212-217, 420-425, 437-442, 499-504, 517-522, 542-547, 733-738

Sushi domain (SCR repeat).
amino acids 359-414, 534-591, 712-767, 773-832, 840-897

CUB domains.
amino acids 418-526, 595-703

FIGURE 115

MAPPAAPGRDRVGREDEDGWETRGDRKARKPLVEKKRRARINESLQELRLLLAGAEAKLENAEVLELTVRRVQGVLR
GRAREREQLQAEASERFAAGYIQCMHEVHTFVSTCQAIDATVAAELLNHLLESMPLREGSSFQDLLGDALAGPPRAP
GRSGWPAGGAPGSPIPSPPGPGDDLCSDLEEAPEAELSQAPAEGPDLVPAALGSLTTAQIARSVWRPW

N-glycosylation site.
amino acids 42-45

N-myristoylation sites.
amino acids 74-79, 162-167, 207-212

Cell attachment sequence.
amino acids 23-26

Helix-loop-helix DNA-binding domain.
amino acids 26-76

FIGURE 116

MESSAKMESGGAGQQPQPQPQQPFLPPAACFFATAAAAAAAAAAAAAQSAQQQQQQQQQQQQQQAPQLRPAADGQPS
GGGHKSAPKQVKRQRSSSPELMRCKRRLNFSGFGYSLPQQQPAAVARRNERERNRVKLVNLGFATLREHVPNGAANK
KMSKVETLRSAVEYIRALQQLLDEHDAVSAAFQAGVLSPTISPNYSNDLNSMAGSPVSSYSSDEGSYDPLSPEEQEL
LDFTNWF

Transmembrane domain.
amino acids 25-45

N-glycosylation sites.
amino acids 106-109, 198-201

Glycosaminoglycan attachment sites.
amino acids 77-80, 108-111 cAMP- and cGMP-dependent protein kinase phosphorylation site.
amino acids 154-157

N-myristoylation sites.
amino acids 74-79, 79-84, 208-213

Helix-loop-helix DNA-binding domain.
amino acids 123-173

FIGURE 117

MELDFGHFDERDKTSRNMRGSRMNGLPSPTHSAHCSFYRTRTLQALSNEKKAKKVRFYRNGDRYFKGIVYAVSSDRF
RSFDALLADLTRSLSDNINLPQGVRYIYTIDGSRKIGSMDELEEGESYVCSSDNFFKKVEYTKNVNPNWSVNVKTSA
NMKAPQSLASSNSAQARENKDFVRPKLVTIIRSGVKPRKAVRVLLNKKTAHSFEQVLTDITEAIKLETGVVKKLYTL
DGKQVTCLHDFFGDDDVFIACGPEKFRYAQDDFSLDENECRVMKGNPSATAGPKASPTPQKTSAKSPGPMRRSKSPA
DSANGTSSSQLSTPKSKQSPISTPTSPGSLRKHKDLYLPLSLDDSDSLGDSM

N-glycosylation sites.
amino acids 145-147, 312-315

N-myristoylation sites.
amino acids 20-25, 67-72, 276-281, 313-328

Doublecortin homology.
amino acids 70-134, 197-258

FIGURE 118

MGGAVSAGEDNEELIDNLKEAQYIRTELVEQAFRAIDRADYYLEEFKENAYKDLAWKHGNIHLSAPCIYSEVMEALD
LQPGLSFLNLGSGTGYLSSMVGLILGPFGVNHGVELHSDVIEYAKQKLDFFIRTSDSFDKFDFCEPSFVTGNCLEIS
PDCSQYDRVYCGAGVQKEHEEYMKNLLKVGGILVMPLEEKLTKITRTGPSAWETKKILAVSFAPLIQPCHSESGKSR
LVQLPPVAVRSLQDLARIAIRGTIKKIIHQETVSKNGNGLKNTPRFKRRRVRRRRMETIVFLDKEVFASRISNPSDD
NSCEDLEEERREEEEKTPPETKPDPPVNFLRQKVLSLPLPDPLKYYLLYYREK

Glycosaminoglycan attachment site.
amino acids 89-92

Tyrosine kinase phosphorylation site.
amino acids 34-41

N-myristoylation sites.
amino acids 2-7, 3-8, 88-93, 106-111

Protein-L-isoaspartate(D-aspartate) O-methyl.
amino acids 9-224

FIGURE 119

MALPRCTWPNYVWRAVMACLVHRGLGAPLTLCMLGCLLQAGHVLSQKLDDVDPLVATNFGKIRGIKKELNNEILGPV
IQFLGVPYAAPPTGERRFQPPEPPSPWSDIRNATQFAPVCPQNIIDGRLPEVMLPVWFTNNLDVVSSYVQDQSEDCL
YLNIYVPTEDDIRDSGGPKPVMVYIHGGSYMEGTGNLYDGSVLASYGNVIVITVNYRLGVLGFLSTGDQAAKGNYGL
LDLIQALRWTSENIGFFGGDPLRITVFGSGAGGSCVNLLTLSHYSEGNRWSNSTKGLFQRAIAQSGTALSSWAVSFQ
PAKYARMLATKVGCNVSDTVELVECLQKKPYKELVDQDIQPARYHIAFGPVIDGDVIPDDPQILMEQGEFLNYDIML
GVNQGEGLKFVENIVDSDDGISASDFDFAVSNFVDNLYGYPEGKDVLRETIKFMYTDWADRHNPETRRKTLLALFTD
HQWVAPAVATADLHSNFGSPTYFYAFYHHCQTDQVPAWADAAHGDEVPYVLGIPMIGPTELFPCNFSKNDVMLSAVV
MTYWTNFAKTGDPNQPVPQDTKFIHTKPNRFEEVAWTRYSQKDQLYLHIGLKPRVKEHYRANKVNLWLELVPHLHNL
NDISQYTSTTTKVPSTDITFRPTRKNSVPVTSAFPTAKQDDPKQQPSPFSVDQRDYSTELSVTIAVGASLLFLNILA
FAALYYKKDKRRHDVHRRCSPQRTTTNDLTHAQEEEIMSLQMKHTDLDHECESIHPHEVVLRTACPPDYTLAMRRSP
DDVPLMTPNTITMIPNTIPGIQPLHTFNTFTGGQNNTLPHPHPHPHSHSTTRV

Transmembrane domain.
amino acids 675-695

Signal sequence.
amino acids 1-40

N-glycosylation sites.
amino acids 109-112, 283-286, 323-526, 527-530, 805-808

Glycosaminoglycan attachment site.
amino acids 260-263 cAMP- and cGMP-dependent protein kinase phosphorylation sites.
amino acids 452-455, 640-643, 710-713

N-myristoylation sites.
amino acids 26-31, 82-87, 194-199, 259-264, 261-266, 264-269, 278-283, 297-302, 321-326, 386-391, 405-410, 802-807, 803-808

Carboxylesterases type-B signature 2.
amino acids 151-161

Carboxylesterase homology.
amino acids 33-606

FIGURE 120

MLRALSRLGAGTPCRPRAPLVLPARGRKTRHDPLAKSKIERVNMPPAVDPAEFFVLMERYQHYRQTVRALRMEFVSE
VQRKVHEARAGVLAERKALKDAAEHRELMAWNQAENRRLHELRIARLRQEEREQEQRQALEQARKAEEVQAWAQRKE
REVLQLQEEVKNFITRENLEARVEAALDSRKNYNWAITREGLVVRPQRRDS cAMP- and cGMP-dependent protein kinase phosphorylation site.
amino acids 202-205

Amidation site.
amino acids 25-28

FIGURE 121

MPGMICKNPDLEFDSLQPCFYPDEDDFYFGGPDSTPPGEDIWKKFELLPTPPLSPSRGFAEHSSEPPSWVTEMLLEN
ELWGSPAEEDAFGLGGLGGLTPNPVILQDCMWSGFSAREKLERAVSEKLQHGRGPPTAGSTAQSPGAGAASPAGRGH
GGAAGAGRAGAALPAELAHPAAECVDPAVVFPFPVNKREPAPVPAAPASAPAAGPAVASGAGIAAPAGAPGVAPPRP
GGRQTSGGDHKALSTSGEDTLSDSDDEDDEEEDEEEEIDVVTVEKRRSSSNTKAVTTFTITVRPKNAALGPGRAQSS
ELILKRCLPIHQQHNYAAPSPYVESEDAPPQKKIKSEASPRPLKSVVPPKAKSLSPRNSDSEDSERRRNHNILERQR
RNDLRSSFLTLRDHVPELVKNEKAAKVVILKKATEYVHSLQAEEHQLLLEKEKLQARQQQLLKKIEHARTC

Transmembrane domain.
amino acids 204-224

Glycosaminoglycan attachment site.
amino acids 213-216 cAMP- and cGMP-dependent protein kinase phosphorylation sites.
amino acids 276-279, 277-280, 416-419

N-myristoylation sites.
amino acids 30-35, 92-97, 143-148, 155-160, 156-161, 159-164, 214-219, 232-237

Leucine zipper pattern.
amino acids 425-446

Myc amino-terminal region.
amino acids 1-364

Helix-loop-helix DNA-binding domain.
amino acids 374-426

FIGURE 122

MHHQQRMAALGTDKELSDLLDFSAMFSPPVSSGKNGPTSLASGHFTGSNVEDRSSSGSWGNGGHPSPSRNYGDGTPY
DHMTSRDLGSHDNLSPPFVNSRIQSKTERGSYSSYGRESNLQGCHQQSLLGGDMDMGNPGTLSPTKPGSQYYQYSSN
NPRRRPLHSSAMEVQTKKVRKVPPGLPSSVYAPSASTADYNRDSPGYPSSKPATSTFPSSFFMQDGHHSSDPWSSSS
GMNQPGYAGMLGNSSHIPQSSSYCSLHPHERLSYPSHSSADINSSLPPMSTFHRSGTNHYSTSSCTPPANGTDSIMA
NRGSGAAGSSQTGDALGKALASIYSPDHTNNSFSSNPSTPVGSPPSLSAGTAVWSRNGGQASSSPNYEGPLHSLQSR
IEDRLERLDDAIHVLRNHAVGPSTAMPGGHGDMHGIIGPSHNGAMGGLGSGYGTGLLSANRHSLMVGTHREDGVALR
GSHSLLPNQVPVPQLPVQSATSPDLNPPQDPYRGMPPGLQGQSVSSGSSEIKSDDEGDENLQDTKSSEDKKLDDDKK
DIKSITSNNDDEDLTPEQKAEREKERRMANNARERLRVRDINEAFKELGRMVQLHLKSDKPQTKLLILHQAVAVILS
LEQQVRERNLNPKAACLKRREEEKVSSEPPPLSLAGPHPGMGDASNHMGQM

N-glycosylation sites.
amino acids 244-247, 274-277, 301-304, 338-341

Glycosaminoglycan attachment site.
amino acids 435-438

Tyrosine kinase phosphorylation site.
amino acids 69-77

N-myristoylation sites.
amino acids 57-62, 86-91, 107-112, 134-139, 179-184, 240-245, 311-316, 313-318, 316-321, 350-355, 366-371, 367-370, 428-433, 431-436, 432-437, 434-439, 440-445, 496-501, 503-508, 656-651

Helix-loop-helix DNA-binding domain.
amino acids 565-618

FIGURE 123

MSSKQATSPFACAADGEDAMTQDLTSREKEEGSDQHVASHLPLHPIMHNKPHSEELPTLVSTIQQDADWDSVLSSQQ
RMESENNKLCSLYSFRNTSTSPHKPDEGSRDREIMTSVTFGTPERRKGSLADVVDTLKQKKLEEMTRTEQEDSSCME
KLLSKDWKEKMERLNTSELLGEIKGTPESLAEKERQLSTMITQLISLREQLLAAHDEQKKLAASQIEKQRQQMDLAR
QQQEQIARQQQQLLQQQHKINLLQQQIQVQGHMPPLMIPIFPHDQRTLAAAAAAQQGFLFPPGITYKPGDNYPVQFI
PSTMAAAAASGLSPLQLQKGHASHPQINQRLKGLSDRFGRNLDTFEHGGGHSYNHKQIEQLYAAQLASMQVSPGAKM
PSTPQPPNTAGTVSPTGIKNEKRGTSPVTQVKDEAAAQPLNLSSRPKTAEPVKSPTSPTQNLFPASKTSPVNLPNKS
SIPSPIGGSLGRGSSLDILSSLNSPALFGDQDTVMKAIQEARKMREQIQREQQQQQPHGVDGKLSSINNMGLNSCRN
EKERTRFENLGPQLTGKSNEDGKLGPGVIDLTRPEDAEGGATVAEARVYRDARGRASSEPHIKRPMNAFMVWAKDER
RKILQAFPDMHNSNISKILGSRWKSMSNQEKQPYYEEQARLSKIHLEKYPNYKYKPRPKRTCIVDGKKLRIGEYKQL
MRSRRQEMRQFFTVGQQPQIPITTGTGVVYPGAITMATTTPSPQMTSDCSSTSASPEPSLPVIQSTYGMKTDGGSLA
GNEMINGEDEMEMYDDYEDDPKSDYSSENEAPEAVSAN

N-glycosylation sites.
amino acids 94-97, 169-172, 426-429, 460-463, 630-633 cAMP- and cGMP-dependent protein kinase phosphorylation sites.
amino acids 123-126, 407-410

Tyrosine kinase phosphorylation site.
amino acids 364-340

N-myristoylation sites.
amino acids 179-184, 356-361, 469-474, 533-538, 579-584, 766-771, 767-772

Amidation site.
amino acids 681-684

ATP/GTP-binding site motif A (P-loop).
amino acids 550-557

Leucine zipper pattern.
amino acids 184-205

HMG (high mobility group) box.
amino acids 601-669

FIGURE 124

MWKVSALLFVLGSASLWVLAEGASTGQPEDDTETTGLEGGVAMPGAEDDVVTPGTSEDRYKSGLTTLVATSVNSVTG
IRIEDLPTSESTVHAQEQSPSATASNVATSHSTEKVDGDTQTTVEKDGLSTVTLVGIIVGVLLAIGFIGGIIVVVMR
KMSGRP

Signal sequence.
amino acids 1-20

Transmembrane domain.
amino acids 128-148 cAMP- and cGMP-dependent protein kinase phosphorylation site.
amino acids 154-157

N-myristoylation sites.
amino acids 22-27, 36-41, 133-138, 137-142

FIGURE 125

SQQLWLGSPDEVWLYLVCEHTHIFTAIIWDSRTRFGSTDFSFHPSIAGVVVLLLLQGGSAYKLVCYFTNWSQDRQEP
GKFTPENIDPFLCSHLIYSFASIENNKVIIKDKSEVMLYQTINSLKTKNPKLKILLSIGGYLFGSKGFHPMVDSSTS
RLEFINSIILFLRNHNFDGLDVSWIYPDQKENTHFTVLIHELAEAFQKDFTKSTKERLLLTAGVSAGRQMIDNSYQV
EKLAKDLDFINLLSFDFHGSWEKPLITGHNSPLSKGWQDRGPSSYYNVEYAVGYWIHKGMPSEKVVMGIPTYGHSFT
LASAETTVGAPASGPGAAGPITESSGFLAYYEICQFLKGAKITRLQDQQVPYAVKGNQWVGYDDVKSMETKVQFLKN
LNLGGAMIWSIDMDDFTGKSCNQGPYPLVQAVKRSLGSL

N-glycosylation site.
amino acids 69-72

Glycosaminoglycan attachment site.
amino acids 321-324

Tyrosine kinase phosphorylation site.
amino acids 108-116, 222-230

N-myristoylation sites.
amino acids 173-178, 217-222, 317-322, 347-352

FIGURE 126

MIPFLPMFSLLLLLIVNPINANNHYDKILAHSRIRGRDQGPNVCALQQILGTKKKYFSTCKNWYKKSICGQKTTVLY
ECCPGYMRMEGMKGCPAVLPIDHVYGTLGIVGATTTQRYSDASKLREEIEGKGSFTYFAPSNEAWDNLDSDIRRGLE
SNVNVELLNALHSHMINKRMLTKDLKNGMIIPSMYNNLGLFINHYPNGVVTVNCARIIHGNQIATNGVVHVIDRVLT
QIGTSIQDFIEAEDDLSSFRAAAITSDILEALGRDGHFTLFAPTNEAFEKLPRGVLERIMGDKVASEALMKYHILNT
LQCSESIMGGAVFETLEGNTIEIGCDGDSITVNGIKMVNKKDIVTNNGVIHLIDQVLIPDSAKQVIELAGKQQTTFT
DLVAQLGLASALRPDGEYTLLAPVNNAFSDDTLSMDQRLLKLILQNHILKVKVGLNELYNGQILETIGGKQLRVFVY
RTAVCIENSCMEKGSKQGRNGAIHIFREIIKPAEKSLHEKLKQDKRFSTFLSLLEAADLKELLTQPGDWTLFVPTND
AFKGMTSEEKEILIRDKNALQNIILYHLTPGVFIGKGFEPGVTNILKTTQGSKIFLKEVNDTLLVNELKSKESDIMT
TNGVIHVVDKLLYPADTPVGNDQLLEILNKLIKYIQIKFVRGSTFKEIPVTVYRPTLTKVKIEGEPEFRLIKEGETI
TEVIHGEPIIKKYTKIIDGVPVEITEKETREERIITGPEIKYTRISTGGGETEETLKKLLQEEVTKVTKFIEGGDGH
LFEDEEIKRLLQGDTPVRKLQANKKVQGSRRRLREGRSQ

Signal sequence.
amino acids 1-21

N-glycosylation site.
amino acids 599-602 cAMP- and cGMP-dependent protein kinase phosphorylation site.
amino acids 507-510, 704-707

N-myristoylation sites.
amino acids 70-75, 106-111, 109-114, 152-157, 193-198, 214-219, 392-397, 476-481, 570-575, 741-746

Fasciclin domains.
amino acids 94-232, 234-367, 370-494, 496-630

FIGURE 127

MSLSAFTLFLALIGGTSGQYYDYDFPLSIYGQSSPNCAPECNCPESYPSAMYCDELKLKSVPMVPPGIKYLYLRNNQ
IDHIDEKAFENVTDLQWLILDHNLLENSKIKGRVFSKLKQLKKLHINHNNLTESVGPLPKSLEDLQLTHNKITKLGS
FEGLVNLTFIHLQHNRLKEDAVSAAFKGLKSLEYLDLSFNQIARLPSGLPVSLLTLYLDNNKISNIPDEYFKRFNAL
QYLRLSHNELADSGIPGNSFNVSSLVELDLSYNKLKNIPTVNENLENYYLEVNQLEKFDIKSFCKILGPLSYSKIKH
LRLDGNRISETSLPPDMYECLRVANEVTLN

Signal sequence.
amino acids 1-18

N-glycosylation sites.
amino acids 88-91, 127-130, 160-163, 252-255

N-myristoylation sites.
amino acids 14-19, 153-158, 202-207, 245-250, 248-253, 313-318

Leucine zipper pattern.
amino acids 121-142

Leucine rich repeats.
amino acids 67-90, 91-116, 117-136, 138-159, 160-184, 185-204, 206-229, 230-254, 255-277, 305-330

Leucine rich repeat N-terminal domain.
amino acids 36-66

FIGURE 128

MSLLLLVVSALHILILILLFVATLDKSWWTLPGKESLNLWYDCTWNNDTKTWACSNVSENGWLKAVQVLMVLSLILC
CLSFILFMFQLYTMRRGGLFYATGLCQLCTSVAVFTGALIYAIHAEEILEKHPRGGSFGYCFALAWVAFPLALVSGI
IYIHLRKRE

Transmembrane domains.
amino acids 62-82, 100-120, 135-155

Signal sequence.
amino acids 1-23

N-glycosylation sites.
amino acids 47-50, 56-59

N-myristoylation sites.
amino acids 95-100, 132-137

PMP-22/EMP/MP20/Claudin family homology.
amino acids 1-156

FIGURE 129

MAPFEPLASGILLLLWLIAPSRACTCVPPHPQTAFCNSDLVIRAKFVGTPEVNQTTLYQRYEIKMTKMYKGFQALGD
AADIRFVYTPAMESVCGYFHRSHNRSEEFLIAGKLQDGLLHITTCSFVAPWNSLSLAQRRGFTKTYTVGCEECTVFP
CLSIPCKLQSGTHCLWTDQLLQGSEKGFQSRHLACLPREPGLCTWQSLRSQIA

Signal sequence.
amino acids 1-23

N-glycosylation sites.
amino acids 53-56, 101-104

N-myristoylation sites.
amino acids 146-151, 177-182

Tissue inhibitors of metalloproteinases signature.
amino acids 24-36

Tissue inhibitor of metalloproteinase.
amino acids 22-199

FIGURE 130

MGVKASQTGFVVLVLLQCCSAYKLVCYYTSWSQYREGDGSCFPDALDRFLCTHIIYSFANISNDHIDTWEWNDVTLY
GMLNTLKNRNPNLKTLLSVGGWNFGSQRFSKIASNTQSRRTFIKSVPPFLRTHGFDGLDLAWLYPGRRDKQHFTTLI
KEMKAEFIKEAQPGKKQLLLSAALSAGKVTIDSSYDIAKISQHLDFISIMTYDFHGAWRGTTGHHSPLFRGQEDASP
DRFSNTDYAVGYMLRLGAPASKLVMGIPTFGRSFTLASSETGVGAPISGPGIPGRFTKEAGTLAYYEICDFLRGATV
HRTLGQQVPYATKGNQWVGYDDQESVKSKVQYLKDRQLAGAMVWALDLDDFQGSFCGQDLRFPLTNAIKDALAAT

Signal sequence.
amino acids 1-21

N-glycosylation site.
amino acids 60-63

Glycosaminoglycan attachment site.
amino acids 279-282

Tyrosine kinase phosphorylation site.
amino acids 182-189

N-myristoylation sites.
amino acids 2-7, 78-83, 134-139, 210-215, 225-230, 248-253, 275-280, 361-366

Amidation sites.
amino acids 142-145, 167-170

Sugar transport proteins signature 2.
amino acids 208-233

Glycosyl hydrolases family homology.
amino acids 182-357

FIGURE 131

MDKFWWHAAWGLCLVPLSLAQIDLNITCRFAGVFHVEKNGRYSISRTEAADLCKAFNSTLPTMAQMEKALSIGFETC
RYGFIEGHVVIPRIHPNSICAANNTGVYILTYNTSQYDTYCFNASAPPEEDCTSVTDLPNAFDGPITITIVNRDGTR
YVQKGEYRTNPEDIYPSNPTDDDVSSGSSSERSSTSGGYIFYTFSTVHPIPDEDSPWITDSTDRIPATRDQDTFHPS
GGSHTTHGSESDGHSHGSQEGGANTTSGPIRTPQIPEWLIILASLLALALILAVCIAVNSRRRCGQKKKLVINSGNG
AVEDRKPSGLNGEASKSQEMVHLVNKESSETPDQFMTADETRNLQNVDMKIGV

Transmembrane domain.
amino acids 267-287

Signal sequence.
amino acids 1-20

N-glycosylation sites.
amino acids 25-28, 57-60, 100-103, 110-113, 120-123, 255-258

Glycosaminoglycan attachment site.
amino acids 305-308 cAMP- and cGMP-dependent protein kinase phosphorylation site.
amino acids 313-318

Tyrosine kinase phosphorylation site.
amino acids 162-169

N-myristoylation sites.
amino acids 232-237, 233-238, 248-253, 252-257, 253-258

Extracellular link domain.
amino acids 31-119

FIGURE 132A

MGAMTQLLAGVFLAFLALATEGGVLKKVIRHKRQSGVNATLPEENQPVVFNHVYNIKLPVGSQCSVDLESASGEKDL
APPSEPSESFQEHTVDGENQIVFTHRINIPRRACGCAAAPDVKELLSRLEELENLVSSLREQCTAGAGCCLQPATGR
LDTRPFCSGRGNFSTEGCGCVCEPGWKGPNCSEPECPGNCHLRGRCIDGQCICDDGFTGEDCSQLACPSDCNDQGKC
VNGVCICFEGYAGADCSREICPVPCSEEHGTCVDGLCVCHDGFAGDDCNKPLCLNNCYNRGRCVENECVCDEGFTGE
DCSELICPNDCFDRGRCINGTCYCEEGFTGEDCGKPTCPHACHTQGRCEEGQCVCDEGFAGLDCSEKRCPADCHNRG
RCVDGRCECDDGFTGADCGELKCPNGCSGHGRCVNGQCVCDEGYTGEDCSQLRCPNDCHSRGRCVEGKCVCEQGFKG
YDCSDMSCPNDCHQHGRCVNGMCVCDDGYTGEDCRDRQCPRDCSNRGLCVDGQCVCEDGFTGPDCAELSCPNDCHGQ
GRCVNGQCVCHEGFMGKDCKEQRCPSDCHGQGRCVDGQCICHEGFTGLDCGQHSCPSDCNNLGQCVSGRCICNEGYS
GEDCSEVSPPKDLVVTEVTEETVNLAWDNEMRVTEYLVVYTPTHEGGLEMQFRVPGDQTSTIIQELEPGVEYFIRVF
AILENKKSIPVSARVATYLPAPEGLKFKSIKETSVEVEWDPLDIAFETWEIIFRNMNKEDEGEITKSLRRPETSYRQ
TGLAPGQEYEISLHIVKNNTRGPGLKRVTTTRLDAPSQIEVKDVTDTTALITWFKPLAEIDGIELTYGIKDVPGDRT
TIDLTEDENQYSIGNLKPDTEYEVSLISRRGDMSSNPAKETFTTGLDAPRNLRRVSQTDNSITLEWRNGKAAIDSYR
IKYAPISGGDHAEVDVPKSQQATTKTTLTGLRPGTEYGIGVSAVKEDKESNPATINAATELDTPKDLQVSETAETSL
TLLWKTPLAKFDRYRLNYSLPTGQWVGVQLPRNTTSYVLRGLEPGQEYNVLLTAEKGRHKSKPARVKASTEQAPELE
NLTVTEVGWDGLRLNWTAADQAYEHFIIQVQEANKVEAARNLTVPGSLRAVDIPGLKAATPYTVSIYGVIQGYRTPV
LSAEASTGETPNLGEVVVAEVGWDALKLNWTAPEGAYEYFFIQVQEADTVEAAQNLTVPGGLRSTDLPGLKAATHYT
ITIRGVTQDFSTTPLSVEVLTEEVPDMGNLTVTEVSWDALRLNWTTPDGTYDQFTIQVQEADQVEEAHNLTVPGSLR
SMEIPGLRAGTPYTVTLHGEVRGHSTRPLAVEVVTEDLPQLGDLAVSEVGWDGLRLNWTAADNAYEHFVIQVQEVNK
VEAAQNLTLPGSLRAVDIPGLEAATPYRVSIYGVIRGYRTPVLSAEASTAKEPEIGNLNVSDITPESFNLSWMATDG
IFETFTIEIIDSNRLLETVEYNISGAERTAHISGLPPSTDFIVYLSGLAPSIRTKTISATATTEALPLLENLTISDI
NPYGFTVSWMASENAFDSFLVTVVDSGKLLDPQEFTLSGTQRKLELRGLITGIGYEVMVSGFTQGHQTKPLRAEIVT
EAEPEVDNLLVSDATPDGFRLSWTADEGVFDNFVLKIRDTKKQSEPLEITLLAPERTRDLTGLREATEYEIELYGIS
KGRRSQTVSAIATTAMGSPKEVIFSDITENSATVSWRAPTAQVESFRITYVPITGGTPSMVTVDGTKTQTRLVKLIP
GVEYLVSIIAMKGFEESEPVSGSFTTALDGPSGLVTANITDSEALARWQPAIATVDSYVISYTGEKVPEITRTVSGN
TVEYALTDLEPATEYTLRIFAEKGPQKSSTITAKFTTDLDSPRDLTATEVQSETALLTWRPPRASVTGYLLVYESVD
GTVKEVIVGPDTTSYSLADLSPSTHYTAKIQALNGPLRSNMIQTIFTTIGLLYPFPKDCSQAMLNGDTTSGLYTIYL
NGDKAQALEVFCDMTSDGGGWIVFLRRKNGRENFYQNWKAYAAGFGDRREEFWLGLDNLNKITAQGQYELRVDLRDH
GETAFAVYDKFSVGDAKTRYKLKVEGYSGTAGDSMAYHNGRSFSTFDKDTDSAITNCALSYKGAFWYRNCHRVNLMG
RYGDNNHSQGVNWFHWKGHEHSIQFAEMKLRPSNFRNLEGRRKRA

Signal sequence.
amino acids 1-19

N-glycosylation sites. 38-41, 166-169, 184-187, 327-330, 788-791, 1018-1021, 1034-1037, 1079-1082, 1093-1096, 1119-1122, 1184-1187, 1210-1213, 1261-1264, 1275-1278, 1301-1304, 1366-1369, 1392-1395, 1445-1448, 1455-1458, 1485-1488, 1534-1537, 1809-1812, 2162-2165

Glycosaminoglycan attachment sites.
amino acids 162-165, 413-416

FIGURE 132B cAMP- and cGMP-dependent protein kinase phosphorylation sites.
amino acids 32-35, 796-799, 900-903, 1658-1661

Tyrosine kinase phosphorylation sites.
amino acids 762-768, 1477-4184, 2030-2037

N-myristoylation sites.
amino acids 10-15, 36-41, 61-66, 143-148, 165-170, 203-208, 234-239, 244-249, 266-271, 328-333, 359-364, 369-374, 400-405, 421-426, 483-488, 514-519, 538-543, 545-550, 569-574, 576-581, 586-591, 602-607, 772-777, 832-837, 932-937, 954-959, 958-963, 962-967, 1024-1029, 1042-1047, 1046-1051, 1089-1094, 1124-1129, 1133-1138, 1146-1151, 1215-1220, 1216-1221, 1224-1229, 1306-1311, 1315-1320, 1319-1324, 1362-1367, 1397-1402, 1406-1411, 1419-1424, 1463-1468, 1488-1493, 1497-1502, 1510-1515, 1588-1593, 1645-1650, 1679-1684, 1692-1697, 1749-1754, 1793-1798, 1804-1809

Amidation sites.
amino acids 1695-1698, 2195-2198

Cell attachment sequence.
amino acids 877-879

EGF-like domain cysteine pattern signatures.
amino acids 174-185, 205-216, 236-247, 268-379, 299-310, 330-341, 361-372, 392-403, 423-434, 454-465, 485-496, 516-527, 547-558, 578-588, 609-620

Fibronectin type III domains.
amino acids 623-701, 712-795, 803-882, 893-974, 985-1062, 1074-1157, 1165-1243, 1256-1335, 1347-1430, 1438-1514, 1529-1608, 1620-1699, 1710-1788, 1799-1876, 1887-1964

Fibrinogen beta and gamma chains.
amino acids 1980-2189

EGF-like domains.
amino acids 185-216, 221-247, 252-279, 284-310, 315-341, 346-372, 377-403, 408-434, 439-465, 470-496, 501-527, 532-558, 563-589, 594-620

FIGURE 133

MNPAAEAEFNILLATDSYKVTHYKQYPPNTSKVYSYFECREKKTENSKLRKVKYEETVFYGLQYILNKYLKGKVVTK
EKIQEAKDVYKEHFQDDVFNEKGWNYILEKYDGHLPIEIKAVPEGFVIPRGNVLFTVENTDPECYWLTNWIETILVQ
SWYPITVATNSREQKKILAKYLLETSGNLDGLEYKLHDFGYRGVSSQETAGIGASAHLVNFKGTDTVAGLALIKKYY
GTKDPVPGYSVPAAEHSTITAWGKDHEKDAFEHIVTQFSSVPVSVVSDSYDIYNACEKIWGEDLRHLIVSRSTQAPL
IIRPDSGNPLDTVLKVLEILGKKFPVTENSKGYKLLPPYLRVIQGDGVDINTLQEIVEGMKQKMWSIENIAFGSGGG
LLQKLTRDLLNCSFKCSYVVTNGLGINVFKDPVADPNKRSKKGRLSLHRTPAGNFVTLEEGKGDLEEYGQDLLHTVF
KNGKVTKSYSFDEIRKNAQLNIELEAAHH

N-glycosylation sites.
amino acids 29-32, 396-399

Glycosaminoglycan attachment site.
amino acids 382-385

Tyrosine kinase phosphorylation sites.
amino acids 53-60, 189-194

N-myristoylation sites.
amino acids 181-186, 205-210, 355-360, 381-386, 408-413, 438-443

Amidation site.
amino acids 328-331

Protein prenyltransferases alpha subunit repeat signature.
amino acids 95-104

Nicotinate phosphoribosyltransferase homology.
amino acids 10-466

FIGURE 134

MALFVRLLALALALALGPAATLAGPAKSPYQLVLQHSRLRGRQHGPNVCAVQKVIGTNRKYFTNCKQWYQRKICGKS
TVISYECCPGYEKVPGEKGCPAALPLSNLYETLGVVGSTTTQLYTDRTEKLRPEMEGPGSFTIFAPSNEAWASLPAE
VLDSLVSNVNIELLNALRYHMVGRRVLTDELKHGMTLTSMYQNSNIQIHHYPNGIVTVNCARLLKADHHATNGVVHL
IDKVISTITNNIQQIIEIEDTFETLRAAVAASGLNTMLEGNGQYTLLAPTNEAFEKIPSETLNRILGDPEALRDLLN
NHILKSAMCAEAIVAGLSVETLEGTTLEVGCSGDMLTINGKAIISNKDILATNGVIHYIDELLIPDSAKTLFELAAE
SDVSTAIDLFRQAGLGNHLSGSERLTLLAPLNSVFKDGTPPIDAHTRNLLRNHIIKDQLASKYLYHGQTLETLGGKK
LRVFVYRNSLCIENSCIAAHDKRGRYGTLFTMDRVLTPPMGTVMDVLKGDNRFSMLVAAIQSAGLTETLNREGVYTV
FAPTNEAFRALPPRERSRLLGDAKELANILKYHIGDEILVSGGIGALVRLKSLQGDKLEVSLKNNVVSVNKEPVAEP
DIMATNGVVHVITNVLQPPANRPQERGDELADSALEIFKQASAFSRASQRSVRLAPVYQKLLERMKH

Signal sequence.
amino acids 1-15

N-myristoylation sites.
amino acids 96-101, 111-116, 114-119, 188-193, 401-406, 489-494, 526-531, 581-586

Amidation sites.
amino acids 176-179, 459-462

Cell attachment sequence.
amino acids 642-644

Fasciclin domains.
amino acids 113-238, 240-373, 376-500, 502-634

FIGURE 135

MKTALILLSILGMACAFSMKNLHRRVKIEDSEENGVFKYRPRYYLYKHAYFYPHLKRFPVQGSSDSSEENGDDSSEE
EEEEEETSNEGENNEESNEDEDSEAENTTLSATTLGYGEDATPGTGYTGLAAIQLPKKAGDITNKATKEKESDEEEE
EEEEGNENEESEAEVDENEQGINGTSTNSTEAENGNGSSGGDNGEEGEEESVTGANAEGTTETGGQGKGTSKTTTSP
NGGFEPTTPPQVYRTTSPPFGKTTTVEYEGEYEYTGVNEYDNGYEIYESENGEPRGDNYRAYEDEYSYFKGQGYDGY
DGQNYYHHQ

Signal sequence.
amino acids 1-16

N-glycosylation sites.
amino acids 104-107, 177-180, 182-187, 190-193

Tyrosine kinase phosphorylation sites.
amino acids 291-297, 291-299

N-myristoylation sites.
amino acids 12-17, 62-67, 121-126, 175-180, 178-183, 189-194, 191-196, 194-199, 213-218, 219-224, 223-228

Cell attachment sequence.
amino acids 286-288

FIGURE 136

MALARGSRQLGALVWGACLCVLVHGQQAQPGQGSDPARWRQLIQWENNGQVYSLLNSGSEYVPAGPQRSESSSRVLL
AGAPQAQQRRSHGSPRRRQAPSLPLPGRVGSDTVRGQARHPFGFGQVPDNWREVAVGDSTGMALARTSVSQQRHGGS
ASSVSASAFASTYRQQPSYPQQFPYPQAPFVSQYENYDPASRTYDQGFVYYRPAGGGVGAGAAAVASAGVIYPYQPR
ARYEEYGGGEELPEYPPQGFYPAPERPYVPPPPPPPDGLDRRYSHSLYSEGTPGFEQAYPDPGPEAAQAHGGDPRLG
WYPPYANPPPEAYGPPRALEPPYLPVRSSDTPPPGGERNGAQQGRLSVGSVYRPNQNGRGLPDLVPDPNYVQASTYV
QRAHLYSLRCAAEEKCLASTAYAPEATDYDVRVLLRFPQRVKNQGTADFLPNRPRHTWEWHSCHQHYHSMDEFSHYD
LLDAATGKKVAEGHKASFCLEDSTCDFGNLKRYACTSHTQGLSPGCYDTYNADIDCQWIDITDVQPGNYILKVHVNP
KYIVLESDFTNNVVRCNIHYTGRYVSATNCKIVQS

Signal sequence.
amino acids 1-25 cAMP- and cGMP-dependent protein kinase phosphorylation site.
amino acids 272-275

Tyrosine kinase phosphorylation site.
amino acids 325-331

N-myristoylation sites.
amino acids 16-21, 33-38, 49-54, 79-84, 138-143, 152-157, 153-158, 209-214, 210-215, 211-216, 213-218, 343-348, 348-353, 503-508, 507-512

Amidation site.
amino acids 468-471

Lysyl oxidase putative copper-binding region signature.
amino acids 443-453

Growth factor and cytokines receptors family signature 1.
amino acids 508-520

Lysyl oxidase homology.
amino acids 370-574

FIGURE 137

MERPLCSHLCSCLAMLALLSPLSLAQYDSWPHYPEYFQQPAPEYHQPQAPANVAKIQLRLAGQKRKHSEGRVEVYYD
GQWGTVCDDDFSIHAAHVVCRELGYVEAKSWTASSSYGKGEGPIWLDNLHCTGNEATLAACTSNGWGVTDCKHTEDV
GVVCSDKRIPGFKFDNSLINQIENLNIQVEDIRIRAILSTYRKRTPVMEGYVEVKEGKTWKQICDKHWTAKNSRVVC
GMFGFPGERTYNTKVYKMFASRRKQRYWPFSMDCTGTEAHISSCKLGPQVSLDPMKNVTCENGLPAVVSCVPGQVFS
PDGPSRFRKAYKPEQPLVRLRGGAYIGEGRVEVLKNGEWGTVCDDKWDLVSASVVCRELGFGSAKEAVTGSRLGQGI
GPIHLNEIQCTGNEKSIIDCKFNAESQGCNHEEDAGVRCNTPAMGLQKKLRLNGGRNPYEGRVEVLVERNGSLVWGM
VCGQNWGIVEAMVVCRQLGLGFASNAFQETWYWHGDVNSNKVVMSGVKCSGTELSLAHCRHDGEDVACPQGGVQYGA
GVACSETAPDLVLNAEMVQQTTYLEDRPMFMLQCAMEENCLSASAAQTDPTTGYRRLLRFSSQIHNNGQSDFRPKNG
RHAWIWHDCHRHYHSMEVFTHYDLLNLNGTKVAEGHKASFCLEDTECEGDIQKNYECANFGDQGITMGCWDMYRHDI
DCQWVDITDVPPGDYLFQVVINPNFEVAESDYSNNIMKCRSRYDGHRIWMYNCHIGGSFSEETEKKFEHFSGLLNNQ
LSPQ

Signal sequence.
amino acids 1-25

N-glycosylation sites.
amino acids 288-291, 455-458, 644-647 cAMP- and cGMP-dependent protein kinase phosphorylation sites.
amino acids 65-68, 196-199

N-myristoylation sites.
amino acids 78-83, 130-135, 144-149, 155-160, 331-336, 378-383, 397-402, 421-426, 461-466, 465-470, 469-474, 481-486, 508-513, 513-518, 534-539, 538-543, 540-545, 645-650, 680-685, 749-754, 765-770

Speract receptor repeated domain signature.
amino acids 331-368

Lysyl oxidase homology.
amino acids 548-751

Scavenger receptor cysteine-rich domains.
amino acids 66-159, 203-292, 329-425, 438-544

FIGURE 138

MSGGKYVDSEGHLYTVPIREQGNIYKPNNKAMADELSEKQVYDAHTKEIDLVNRDPKHLNDDVVKIDFEDVIAEPEG
THSFHGIWKASFTTFTVTKYWFYRLLSALFGIPMALIWGIYFAILSFLHIWAVVPCIKSFLIEIQCTSRVYSIYVHT
VCDPLFEAVGKIFSNVRINLQKEI

Transmembrane domains.
amino acids 97-117, 113-133

N-myristoylation sites.
amino acids 83-88, 108-113, 116-121

Caveolin homology.
amino acids 1-177

FIGURE 139A

MGQRAVGSLLLGLLLHARLLAVTHGLRAYDGLSLPEDTETVTASRYGWTYSYLSDDEDLLADDASGDGLGSGDVGSG
DFQMVYFRALVNFTRSIEYSPQLEDASAKEFREVSEAVVEKLEPEYRKIPGDQIVSVVFIKELDGWVFVELDVGSEG
NADGSQIQEVLHTVVSSGSIGPYVTSPWGFKFRRLGTVPQFPRVCTETEFACHSYNECVALEYRCDRRPDCRDMSDE
LNCEEPVPELSSSTPAVGKVSPLPLWPEAATTPPPPVTHGPQFLLPSVPGPSACGPQEASCHSGHCIPRDYLCDGQE
DCRDGSDELGCASPPPCEPNEFACENGHCALKLWRCDGDFDCEDRTDEANCSVKQPGEVCGPTHFQCVSTNRCIPAS
FHCDEESDCPDRSDEFGCMPPQVVTPPQQSIQASRGQTVTFTCVATGVPTPIINWRLNWGHIPAHPRVTMTSEGGRG
TLIIRDVKEADQGAYTCEAMNSRGMVFGIPDGVLELVPQRGPCPDGHFYLEDSASCLPCFCFGVTNVCQSSLRFRDQ
IRLSFDQPNDFKGVNVTMPSQPGVPPLSSTQLQIDPALQEFQLVDLSRRFLVHDAFWALPKQFLGNKVDSYGGFLRY
KVRYELARGMLEPVQKPDVILVGAGYRLHSRGHTPTHPGTLNQRQVQLSEEHWVHESGRPVQRAEMLQALASLEAVL
LQTVYNTKMASVGLSDIVMDTTVTHTTIHGRAHSVEECRCPIGYSGLSCESCDAHFTRVPGGPYLGTCSGCNCNGHA
SSCDPVYGHCLNCQHNTEGPQCDKCKPGFFGDATKATATACRPCPCPYIDASRRFSDTCFLDTDGQATCDACAPGYT
GRRCESCAPGYEGNPIQPGGKCRPTTQEIVRCDERGSLGTSGETCRCKNNVVGRLCNECSDGSFHLSKQNPDGCLKC
FCMGVSRQCSSSSWSRAQVLGASEQPSQFSLSNAAGTHTTSEGVSSPAPGELSFSSFHNLLSEPYFWSLPASFRGDK
VTSYGGELRFTVMQRPRPSSAPLHRQPLVVLQGNNIVLEHHASRDPSPGQPSNFIVPFQEQAWQRPDGQPATREHLL
MALAGIDALLIQASYTQQPAESRLSGISMDVAVPENTGQDSAREVEQCTCPPGYRGPSCQDCDTGYTRVPSGLYLGT
CERCNCHGHSETCEPETGACQSCQHHTEGASCEQCQPGYYGDAQRGTPQDCQPCPCYGAPAAGQAAHTCFLDTDGHP
TCDSCSPGHSGRHCERCAPGYYGNPSQGQPCHRDGQVPEVLGCGCDPHGSISSQCDAAGQCQCKAQVEGRSCSHCRP
HHFHLSASNPEGCLPCFCMGVTQQCASSSYSRQLISTHFAPGDFQGFALVNPQRNSQLTGGFTVEPVHDGARLSFSN
FAHLGQESFYWQLPEIYQGDKVAAYGGKLRYTLSYTAGPQGSPLLDPDIQITGNNIMLVASQPALQGPERRSYEIIF
REEFWRRPDGQPATREHLLMALADLDELLVRATFSSVPRAASISAVSLEGAQPGPSSGPRALEVEECRCPPGYVGLS
CQDCAPGYTRTGSGLYLGQCELCECNGHSDLCHPETGACSRCQHNTAGEFCELCATGYYGDATAGTPEDCQPCACPL
TNPENMFSRTCESLGAGGYRCTACEPGYTGQYCEQCAPGYEGDPNVQGGRCQPLTKESLEVQIHPSRSVVPQGGPHS
LRCQVSGSPPHYFYWSREDGRPLPSSAQQRHQGSELHFPSVQPSDAGVYICTCRNLIHTSNSRAELLVAEAPSKPIM
VTVEEQRSQSVRPGADVTFICTAKSKSPAYTLVWTRLHNGKLPSRAMDFNGILTIRNVQPSDAGTYVCTGSNMFAMD
QGTATLHVQVSGTSTAPVASIHPPQLTVQPGQQAEFRCSATGNPTPMLEWIGGPSGQLPAKAQIHNGILRLPAIEPS
DQGQYLCRALSSAGQHVARAMLQVHGGSGPRVQVSPERTQVHEGRTVRLYCRAAGVPSASITWRKEGGSLPFRHQAH
GSRLRLHHMSVADSGEYVCRANNNIDAQETSIMISVSPSTNSPPAPASPAPIRIESSSSRVAEGQTLDLNCVVPGHA
HAQVTWHKRGGSLPTHHQTHGSRLRLYQVSSADSGEYVCSVLSSSGPLEASVLVSITPAAANVHIPGVVPPIRIETS
SSRVAEGQTLDLSCVVPGQAHAQVTWHKRGGSLPAGHQVHGHMLRLNRVSPADSGEYSCQVTGSSGTLEASVLVTIE
ASEPSPIPAPGLAQPVYIESSSSHLTEGQTVDLKCVVPGQAHAQVTWHKRGSSLPARHQTHGSLLRLYQLSPADSGE
YVCQVAGSSHPEHEASFKLTVPSSQNSSFRLRSPVISIEPPSSTVQQGQDASFKCLIHEGAMPIKVEWKIRDQELED
NVHISPNGSIIITIVAPGPATMEPTACVASNVYGMAQSVVNLSVHGPPTVSVLPEGPVHVKMGKDITLECISSGEPRS
SPRWTRLGIPVKLEPRMFGLMNSHAMLKIASVKPSDAGTYVCQAQNALGTAQKQVELIVDTGTVAPGTPQVQVEESE
LTLEAGHTATLHCSATGNPPPTIHWSKLRAPLPWQHRIEGNTLVIPRVAQQDSGQYICNATNSAGHTEATVVLHVES
PPYATIIPEHTSAQPGNLVQLQCLAHGTPPLTYQWSLVGGVLPEKAVVRNQLLRLEPTVPEDSGRYRCQVSNRVGSA
EAFAQVLVQGSSSNLPDTSIPGGSTPTVQVTPQLETRNIGASVEFHCAVPNERGTHLRWLKEGGQLPPGHSVQDGVL
RIQNLDQNCQGTYVCQAHGPWGQAQATAQLIVQALPSVLINVRTSVHSVVVGHSVEFECLALGDPKPQVTWSKVGGH
LRPGIVQSGTIIRIAHVELADAGQYRCAATNAAGTTQSHVLLLVQALPQISTPPEIRVPAGSAAVFPCMASGYPTPA
ITWSKVDGDLPPDSRLENNMLMLPSVRPEDAGTYVCTATNRQGKVKAFAYLQVPERVIPYFTQTPYSFLPLPTIKDA
YRKFEIKITFRPDSADGMLLYNGQKRSPTNLANRQPDFISFGLVGGRPEFRFDAGSGMATIRHPTPLALGQFHTVTL
LRSLTQGSLIVGNLAPVNGTSQGKFQGLDLNEELYLGGYPDYGAIPKAGLSSGFVGCVRELRIQGEEIVFHDVNLTT
HGISHCPTCQDRPCQNGGQCQDSESSSYTCVCPAGFTAAAVNIRKPCTATPSLWADATCVNRPDGRGYTCRCHLGRS
GVRCEEGVTVTTPSMSGAGSYLALPALTNTHHELRLDVEFKPLEPNGILLFSGGKSGPVEDFVSLAMVGGHLEFRYE
LGSGLAVLRSHEPLALGRWHRVSAERLNKDGSLRVDGGRPVLRSSPGKSQGLNLHTLLYLGGVEPSVQLSPATNMSA
HFHGCVGEVSVNGKRLDLTYSFLGSQGVGQCYDSSPCERQPCRNGATCMPAGEYEFQCLCQDGFKGDLCEHEENPCQ
LHEPCLNGGTCRGARCLCLPGFSGPRCQQGAGYGVVESDWHPEGSGGNDAPGQYGAYFYDNGFLGLPGNSFSRSLPE
VPETIEFEVRTSTADGLLLWQGVVREASRSKDFISLGLQDGHLVFSYQLGSGEARLVSGDPINDGEWHRITALREGQ
RGSIQVDGEDLVTGRSPGPNVAVNTKDIIYIGGAPDVATLTRGKFSSGITGCIKNLVLHTARPGAPPPQPLDLQHRA
QAGANTRPCPS

Signal sequence.
amino acids 1-21
N-glycosylation sites.
amino acids 89-92, 358-341, 554-557, 2336-2339, 2394-2397, 2427-2430, 2600-2603,
3098-3101, 3154-3157, 3385-3388
Glycosaminoglycan attachment sites.
amino acids 65-68, 3250-3253
cAMP- and cGMP-dependent protein kinase phosphorylation sites.
amino acids 823-826, 2282-2285
Tyrosine kinase phosphorylation sites.
amino acids 470-477, 2497-2504, 2953-2960, 3402-3408

FIGURE 139B

N-myristoylation sites.
amino acids 68-73, 151-156, 154-159, 306-311, 421-426, 459-464, 475-480, 486-491, 490-495, 552-557, 759-764, 763-768, 835-840, 883-888, 920-925, 960-965, 1050-1055, 1069-1074, 1116-1121, 1150-1155, 1173-1178, 1213-1218, 1281-1286, 1291-1296, 1321-1326, 1379-1384, 1473-1478, 1554-1559, 1634-1639, 1690-1695, 1741-1746, 1785-1790, 1835-1840, 1900-1905, 1904-1909, 1928-1933, 1939-1944, 1980-1985, 2090-2095, 2174-2179, 2187-2192, 2219-2224, 2222-2227, 2272-2277, 2358-2363, 2395-2400, 2420-2425, 2483-2488, 2502-2507, 2595-2600, 2693-2698, 2705-2710, 2718-2723, 2783-2788, 2794-2799, 2853-2858, 2872-2877, 2883-2888, 2958-2963, 3045-3050, 3058-3063, 3073-3078, 3099-3104, 3107-3112, 3129-3134, 3241-3246, 3253-3258, 3313-3318, 3373-3378, 3415-3420, 3474-3479, 3495-3500, 3499-3504, 3509-3514, 3517-3522, 3530-3535, 3533-3538, 3579-3584, 3592-3597, 3618-3623, 3667-3672, 3670-3675
Amidation sites.
amino acids 847-850, 3400-3403
Cell attachment sequence.
amino acids 998-1000
EGF-like domain cysteine pattern signature.
amino acids 731-742, 892-903, 1126-1137, 1293-1304, 1530-1541, 3227-3238, 3446-3457, 3481-3492
Immunoglobulin domains.
amino acids 421-481, 1690-1747, 1785-1841, 1879-1934, 1969-2023, 2066-2120, 2163-2217, 2261-2315, 2358-2415, 2449-2508, 2547-2601, 2634-2688, 2735-2789, 2824-2878, 2910-2964
Laminin G domains.
amino acids 3013-3149, 3274-3405, 3551-3683
Laminin EGF-like (Domains III and V).
amino acids 764-811, 814-869, 878-921, 1159-1206, 1209-1263, 1275-1322, 1563-1610, 1613-1668
Laminin B (Domain IV).
amino acids 595-729, 990-1124, 1396-1528
Low-density lipoprotein receptor domains.
amino acids 197-236, 283-321, 323-361, 366-405
SEA domain.
amino acids 80-194
EGF-like domains.
amino acids 3166-3198, 3425-3457, 3464-3492

FIGURE 140

MQMSPALTCLVLGLALVFGEGSAVHHPPSYVAHLASDFGVRVFQQVAQASKDRNVVFSPYGVASVLAMLQLTTGGET
QQQIQAAMGFKIDDKGMAPALRHLYKELMGPWNKDEISTTDAIFVQRDLKLVQGFMPHFFRLFRSTVKQVDFSEVER
ARFIINDWVKTHTKGMISNLLGKGAVDQLTRLVLVNALYFNGQWKTPFPDSSTHRRLFHKSDGSTVSVPMMAQTNKF
NYTEFTTPDGHYYDILELPYHGDTLSMFIAAPYEKEVPLSALTNILSAQLISHWKGNMTRLPRLLVLPKFSLETEVD
LRKPLENLGMTDMFRQFQADFTSLSDQEPLHVAQALQKVKIEVNESGTVASSSTAVIVSARMAPEEIIMDRPFLFVV
RHNPTGTVLFMGQVMEP

Signal sequence.
amino acids 1-19

N-glycosylation sites.
amino acids 232-235, 288-291, 352-355

N-myristoylation sites.
amino acids 93-95, 169-174, 217-222, 355-560

Serpin (serine protease inhibitor).
amino acids 28-402

FIGURE 141

MKVSAALLCLLLIAATFIPQGLAQPDAINAPVTCCYNFTNRKISVQRLASYRRITSSKCPKEAVIFKTIVAKEICAD
PKQKWVQDSMDHLDKQTQTPKT

Signal sequence.
amino acids 1-23

IL-8 homology.
amino acids 24-90

FIGURE 142

MENPSPAAALGKALCALLLATLGAAGQPLGGESICSARAPAKYSITFTGKWSQTAFPKQYPLFRPPAQWSSLLGAAH
SSDYSMWRKNQYVSNGLRDFAERGEAWALMKEIEAAGEALQSVHEVFSAPAVPSGTGQTSAELEVQRRHSLVSFVVR
IVPSPDWFVGVDSLDLCDGDRWREQAALDLYPYDAGTDSGFTFSSPNFATIPQDTVTEITSSSPSHPANSFYYPRLK
ALPPIARVTLLRLRQSPRAFIPPAPVLPSRDNEIVDSASVPETPLDCEVSLWSSWGLCGGHCGRLGTKSRTRYVRVQ
PANNGSPCPELEEEAECVPDNCV

Signal sequence.
amino acids 1-26

Glycosaminoglycan attachment site.
amino acids 131-134 cAMP- and cGMP-dependent protein kinase phosphorylation site.
amino acids 144-147

N-myristoylation sites.
amino acids 26-31, 74-79, 132-137, 134-139, 190-195, 287-292, 290-295

FIGURE 143

MGLPRLVCAFLLAACCCCPRVAGVPGEAEQPAPELVEVEVGSTALLKCGLSQSQGNLSHVDWFSVHKEKRTLIFRVR
QGQGQSEPGEYEQRLSLQDRGATLALTQVTPQDERIFLCQGKRPRSQEYRIQLRVYKAPEEPNIQVNPLGIPVNSKE
PEEVATCVGRNGYPIPQVIWYKNGRPLKEEKNRVHIQSSQTVESSGLYTLQSILKAQLVKEDKDAQFYCELNYRLPS
GNHMKESREVTVPVFYPTEKVWLEVEPVGMLKEGDRVEIRCLADGNPPPHFSISKQNPSTREAEEETTNDNGVLVLE
PARKEHSGRYECQAWNLDTMISLLSEPQELLVNYVSDVRVSPAAPERQEGSSLTLTCEAESSQDLEFQWLREETDQV
LERGPVLQLHDLKREAGGGYRCVASVPSIPGLNRTQLVKLAIFGPPWMAFKERKVWVKENMVLNLSCEASGHPRPTI
SWNVNGTASEQDQDPQRVLSTLNVLVTPELLETGVECTASNDLGKNTSILFLELVNLTTLTPDSNTTTGLSTSTASP
HTRANSTSTERKLPEPESRGVVIVAVIVCILVLAVLGAVLYFLYKKGKLPCRRSGKQEITLPPSRKTELVVEVKSDK
LPEEMGLLQGSSGDKRAPGDQGEKYIDLRH

Transmembrane domain.
amino acids 559-579

Signal sequence.
amino acids 1-17

N-glycosylation sites.
amino acids 56-59, 418-421, 449-452, 467-470, 508-511, 518-521, 527-530, 544-547

Tyrosine kinase phosphorylation site.
amino acids 214-222

N-myristoylation sites.
amino acids 49-54, 79-74, 98-103, 147-152, 358-363, 403-408, 416-421, 496-501, 531-536, 622-627

Amidation site.
amino acids 117-120

Immunoglobulin domains.
amino acids 41-118, 156-225, 265-322, 358-409, 445-501

FIGURE 144

MEGDRVAGRPVLSSLPVLLLLQLLMLRAAALHPDELFPHGESWGDQLLQEGDDESSAVVKLANPLHFYEARFSNLYV
GTNGIISTQDFPRETQYVDYDFPTDFPAIAPFLADIDTSHGRGRVLYREDTSPAVLGLAARYVRAGFPRSARFTPTH
AFLATWEQVGAYEEVKRGALPSGELNTFQAVLASDGSDSYALFLYPANGLQFLGTRPKESYNVQLQLPARVGFCRGE
ADDLKSEGPYFSLTSTEQSVKNLYQLSNLGIPGVWAFHIGSTSPLDNVRPAAVGDLSAAHSSVPLGRSFSHATALES
DYNEDILDYYDVNEEEAEYLPGEPEEALNGHSSIDVSFQSKVDTKPLEESSTLDPHTKEGTSLGEVGGPDLKGQVEP
WDERETRSPAPPEVDRDSLAPSWETPPPYPENGSIQPYPDGGPVPSEMDVPPAHPEEEIVLRSYPASDHTTPLSRGT
YEVGLEDNIGSNTEVFTYNAANKETCEHNHRQCSRHAFCTDYATGFCCHCQSKFYGNGKHCLPEGAPHRVNGKVSGH
LHVGHTPVHFTDVDLHAYIVGNDGRAYTAISHIPQPAAQALLPLTPIGGLFGWLFALEKPGSENGFSLAGAAFTHDM
EVTFYPGEETVRITQTAEGLDPENYLSIKTNIQGQVPYVPANFTAHISPYKELYHYSDSTVTSTSSRDYSLTFGAIN
QTWSYRIHQNITYQVCRHAPRHPSFPTTQQLNVDRVFALYNDEERVLRFAVTNQIGPVKEDSDPTPVNPCYDGSHMC
DTTARCHPGTGVDYTCECASGYQGDGRNCVDENECATGFHRCGPNSVCINLPGSYRCECRSGYEFADDRHTCILITP
PANPCEDGSHTCAPAGQARCVHHGGSTFSCACLPGYAGDGHQCTDVDECSENRCHPAATCYNTPGSFSCRCQPGYYG
DGFQCIPDSTSSLTPCEQQQRHAQAQYAYPGARFHIPQCDEQGNFLPLQCHGSTGFCWCVDPDGHEVPGTQTPPGST
PPHCGPSPEPTQRPPTICERWRENLLEHYGGTPRDDQYVPQCDDLGHFIPLQCHGKSDFCWCVDKDGREVQGTRSQP
GTTPACIPTVAPPMVRPTPRPDVTPPSVGTFLLYTQGQQIGYLPLNGTRLQKDAAKTLLSLHGSIIVGIDYDCRERM
VYWTDVAGRTISRAGLELGAEPETIVNSGLISPEGLAIDHIRRTMYWTDSVLDKIESALLDGSERKVLFYTDLVNPR
AIAVDPIRGNLYWTDWNREAPKIETSSLDGENRRILINTDIGLPNGLTFDPFSKLLCWADAGTKKLECTLPDGTGRR
VIQNNLKYPFSIVSYADHFYHTDWRRDGVVSVNKHSGQFTDEYLPEQRSHLYGITAVYPYCPTGRK

Transmembrane domain.
amino acids 574-594
Signal sequence.
amino acids 1-30
N-glycosylation sites.
amino acids 417-420, 658-661, 693-696, 703-706, 1124-1127
N-myristoylation sites.
amino acids 81-86, 172-177, 368-373, 466-471, 587-592, 600-605, 609-614, 766-771, 781-786, 823-828, 855-860, 863-868, 872-877, 912-917, 1079-1084, 1115-1120, 1170-1175, 1274-1279
Amidation sites.
amino acids 1306-1309, 1372-1375
Aspartic acid and asparagine hydroxylation sites.
amino acids 501-512, 818-829, 907-918
Thyroglobulin type-1 repeat.
amino acids 940-1005, 1019-1084
Low-density lipoprotein receptor repeats.
amino acids 1154-1196, 1198-1239, 1241-1284, 1286-1326
EGF-like domains.
amino acids 488-523, 763-799, 805-842, 852-890, 896-929

FIGURE 145

MKLVFLVLLFLGALGLCLAGRRRRSVQWCAVSQPEATKCFQWQRNMRKVRGPPVSCIKRDSPIQCIQAIAENRADAV
TLDGGFIYEAGLAPYKLRPVAAEVYGTERQPRTHYYAVAVVKKGGSFQLNELQGLKSCHTGLRRTAGWNVPTGTLRP
FLNWTGPPEPIEAAVARFFSASCVPGADKGQFPNLCRLCAGTGENKCAFSSQEPYFSYSGAFKCLRDGAGDVAFIRE
STVFEDLSDEAERDEYELLCPDNTRKPVDKFKDCHLARVPSHAVVARSVNGKEDAIWNLLRQAQEKFGKDKSPKFQL
FGSPSGQKDLLFKDSAIGFSRVPPRIDSGLYLGSGYFTAIQNLRKSEEEVAARRARVVWCAVGEQELRKCNQWSGLS
EGSVTCSSASTTEDCIALVLKGEADAMSLDGGYVYTACKCGLVPVLAENYKSQQSSDPDPNCVDRPVEGYLAVAVVR
RSDTSLTWNSVKGKKSCHTAVDRTAGWNIPMGLLFNQTGSCKFDEYFSQSCAPGSDPRSNLCALCIGDEQGENKCVP
NSNERYYGYTGAFRCLAENAGDVAFVKDVTVLQNTDGNNNEAWAKDLKLADFALLCLDGKRKPVTEARSCHLAMAPN
HAVVSRMDKVERLKQVLLHQQAKFGRNGSDCPDKFCLFQSETKNLLFNDNTECLARLHGKTTYEKYLGPQYVAGITN
LKKCSTSPLLEACEFLRK

Signal sequence.
amino acids 1-19

N-glycosylation sites.
amino acids 157-160, 498-501, 643-646 cAMP- and cGMP-dependent protein kinase phosphorylation sites.
amino acids 22-25, 58-61, 695-693

N-myristoylation sites.
amino acids 15-20, 131-136, 138-143, 180-185, 184-189, 195-200, 214-219, 310-315, 337-342, 383-388, 387-393, 494-499, 550-555

Amidation sites.
amino acids 19-21, 474-477, 597-600

Transferrins signature 1.
amino acids 113-121

Transferrins signature 2.
amino acids 212-228, 548-564

Transferrin homology.
amino acids 26-353, 365-696

FIGURE 146

MRGSHRAAPALRPRGRLWPVLAVLAAAAAAGCAQAAMDECTDEGGRPQRCMPEFVNAAFNVTVVATNTCGTPPEEYC
VQTGVTGVTKSCHLCDAGQPHLQHGAAFLTDYNNQADTTWWQSQTMLAGVQYPSSINLTLHLGKAFDITYVRLKFHT
SRPESFAIYKRTREDGPWIPYQYYSGSCENTYSKANRGFIRTGGDEQQALCTDEFSDISPLTGGNVAFSTLEGRPSA
YNFDNSPVLQEWVTATDIRVTLNRLNTFGDEVFNDPKVLKSYYYAISDFAVGGRCKCNGHASECMKNEFDKLVCNCK
HNTYGVDCEKCLPFFNDRPWRRATAESASECLPCDCNGRSQECYFDPELYRSTGHGGHCTNCQDNTDGAHCERCREN
FFRLGNNEACSSCHCSPVGSLSTQCDSYGRCSCKPGVMGDKCDRCQPGFHSLTEAGCRPCSCDPSGSIDECNVETGR
CVCKDNVEGFNCERCKPGFFNLESSNPRGCTPCFCFGHSSVCTNAVGYSVYSISSTFQIDEDGWRAEQRDGSEASLE
WSSERQDIAVISDSYFPRYFIAPAKFLGKQVLSYGQNLSFSFRVDRRDTRLSAEDLVLEGAGLRVSVPLIAQGNSYP
SETTVKYVFRLHEATDYPWRPALTPFEFQKLLNNLTSIKIRGTYSERSAGYLDDVTLASARPGPGVPATWVESCTCP
VGYGGQFCEMCLSGYRRETPNLGPYSPCVLCACNGHSETCDPETGVCNCRDNTAGPHCEKCSDGYYGDSTAGTSSDC
QPCPCPGGSSCAVVPKTKEVVCTNCPTGTTGKRCELCDDGYFGDPLGRNGPVRLCRLCQCSDNIDPNAVGNCNRLTG
ECLKCIYNTAGFYCDRCKDGFFGNPLAPNPADKCKACNCNPYGTMKQQSSCNPVTGQCECLPHVTGQDCGACDPGFY
NLQSGQGCERCDCHALGSTNGQCDIRTGQCECQPGITGQHCERCEVNHFGFGPEGCKPCDCHPEGSLSLQCKDDGRC
ECREGFVGNRCDQCEENYFYNRSWPGCQECPACYRLVKDKVADHRVKLQELESLIANLGTGDEMVTDQAFEDRLKEA
EREVMDLLREAQDVKDVDQNLMDRLQRVNNTLSSQISRLQNIRNTIEETGNLAEQARAHVENTERLIEIASRELEKA
KVAAANVSVTQPESTGDPNNMTLLAEEARKLAERHKQEADDIVRVAKTANDTSTEAYNLLLRTLAGENQTAFEIEEL
NRKYEQAKNISQDLEKQAARVHEEAKRAGDKAVEIYASVAQLSPLDSETLENEANNIKMEAENLEQLIDQKLKDYED
LREDMRGKELEVKNLLEKGKTEQQTADQLLARADAAKALAEEAAKKGRDTLQEANDILNNLKDFDRRVNDNKTAAEE
ALRKIPAINQTITEANEKTREAQQALGSAAADATEAKNKAHEAERIASAVQKNATSTKAEAERTFAEVTDLDNEVNN
MLKQLQEAEKELKRKQDDADQDMMMAGMASQAAQEAEINARKAKNSVTSLLSIINDLLEQLGQLDTVDLNKLNEIEG
TLNKAKDEMKVSDLDRKVSDLENEAKKQEAAIMDYNRDIEEIMKDIRNLEDIRKTLPSGCFNTPSIEKP

Signal sequence.
amino acids 1-35
N-glycosylation sites.
amino acids 60-63, 134-137, 576-579, 650-653, 1022-1025, 1107-1110, 1161-1164, 1175-1178, 1205-1208, 1223-1226, 1241-1244, 1380-1383, 1395-1398, 1439-1442
Glycosaminoglycan attachment site.
amino acids 928-931
cAMP- and cGMP-dependent protein kinase phosphorylation sites.
amino acids 329-332, 585-588, 709-802, 1556-1559
Tyrosine kinase phosphorylation sites.
amino acids 141-147, 626-633, 753-759
N-myristoylation sites.
amino acids 3-8, 31-36, 84-89, 180-185, 217-222, 364-369, 390-395, 404-409, 441-446, 491-496, 533-538, 574-579, 601-606, 681-686, 697-702, 738-743, 777-782, 778-783, 903-908, 913-918, 931-936, 941-946, 952-957, 979-984, 1413-1418, 1525-1530
Amidation site.
amino acids 800-803
EGF-like domain cysteine pattern signatures.
amino acids 305-317, 416-428, 463-475, 690-702, 740-752, 905-917, 954-966, 1001-1013
Laminin N-terminal (Domain VI).
amino acids 50-284
Laminin EGF-like (Domains III and V).
amino acids 342-395, 398-442, 445-492, 724-770, 773-825, 828-881, 884-932, 935-980, 983-1028
Laminin B (Domain IV).
amino acids 558-688

FIGURE 147A

MLRGPGPGLLLLAVQCLGTAVPSTGASKSKRQAQQMVQPQSPVAVSQSKPGCYDNGKHYQINQQWERTYLGNALVCT
CYGGSRGFNCESKPEAEETCFDKYTGNTYRVGDTYERPKDSMIWDCTCIGAGRGRISCTIANRCHEGGQSYKIGDTW
RRPHETGGYMLECVCLGNGKGEWTCKPIAEKCFDHAAGTSYVVGETWEKPYQGWMMVDCTCLGEGSGRITCTSRNRC
NDQDTRTSYRIGDTWSKKDNRGNLLQCICTGNGRGEWKCERHTSVQTTSSGSGPFTDVRAAVYQPQPHPQPPPYGHC
VTDSGVVYSVGMQWLKTQGNKQMLCTCLGNGVSCQETAVTQTYGGNSNGEPCVLPFTYNGRTFYSCTTEGRQDGHLW
CSTTSNYEQDQKYSFCTDHTVLVQTRGGNSNGALCHFPFLYNNHNYTDCTSEGRRDNMKWCGTTQNYDADQKFGFCP
MAAHEEICTTNEGVMYRIGDQWDKQHDMGHMMRCTCVGNGRGEWTCIAYSQLRDQCIVDDITYNVNDTFHKRHEEGH
MLNCTCFGQGRGRWKCDPVDQCQDSETGTFYQIGDSWEKYVHGVRYQCYCYGRGIGEWHCQPLQTYPSSSGPVEVFI
TETPSQPNSHPIQWNAPQPSHISKYILRWRPKNSVGRWKEATIPGHLNSYTIKGLKPGVVYEGQLISIQQYGHQEVT
RFDFTTTSTSTPVTSNTVTGETTPFSPLVATSESVTEITASSFVVSWVSASDTVSGFRVEYELSEEGDEPQYLDLPS
TATSVNIPDLLPGRKYIVNVYQISEDGEQSLILSTSQTTAPDAPPDPTVDQVDDTSIVVRWSRPQAPITGYRIVYSP
SVEGSSTELNLPETANSVTLSDLQPGVQYNITIYAVEENQESTPVVIQQETTGTPRSDTVPSPRDLQFVEVTDVKVT
IMWTPPESAVTGYRVDVIPVNLPGEHGQRLPISRNTFAEVTGLSPGVTYYFKVFAVSHGRESKPLTAQQTTKLDAPT
NLQFVNETDSTVLVRWTPPRAQITGYRLTVGLTRRGQPRQYNVGPSVSKYPLRNLQPASEYTVSLVAIKGNQESPKA
TGVFTTLQPGSSIPPYNTEVTETTIVITWTPAPRIGFKLGVRPSQGGEAPREVTSDSGSIVVSGLTPGVEYVYTIQV
LRDGQERDAPIVNKVVTPLSPPTNLHLEANPDTGVLTVSWERSTTPDITGYRITTTPTNGQQGNSLEEVVHADQSSC
TFDNLSPGLEYNVSVYTVKDDKESVPISDTIIPAVPPPTDLRFTNIGPDTMRVTWAPPPSIDLTNFLVRYSPVKNEE
DVAELSISPSDNAVVLTNLLPGTEYVVSVSSVYEQHESTPLRGRQKTGLDSPTGIDFSDITANSFTVHWIAPRATIT
GYRIRHHPEHFSGRPREDRVPHSRNSITLTNLTPGTEYVVSIVALNGREESPLLIGQQSTVSDVPRDLEVVAATPTS
LLISWDAPAVTVRYYRITYGETGGNSPVQEFTVPGSKSTATISGLKPGVDYTITVYAVTGRGDSPASSKPISINYRT
EIDKPSQMQVTDVQDNSISVKWLPSSSPVTGYRVTTTPKNGPGPTKTKTAGPDQTEMTIEGLQPTVEYVVSVYAQNP
SGESQPLVQTAVTNIDRPKGLAFTDVDVDSIKIAWESPQGQVSRYRVTYSSPEDGIHELFPAPDGEEDTAELQGLRP
GSEYTVSVVALHDDMESQPLIGTQSTAIPAPTDLKFTQVTPTSLSAQWTPPNVQLTGYRVRVTPKEKTGPMKEINLA
PDSSSVVVSGLMVATKYEVSVYALKDTLTSRPAQGVVTTLENVSPPRRARVTDATETTITISWRTKTETITGFQVDA
VPANGQTPIQRTIKPDVRSYTITGLQPGTDYKIYLYTLNDNARSSPVVIDASTAIDAPSNLRFLATTPNSLLVSWQP
PRARITGYIIKYEKPGSPPREVVPRPRPGVTEATITGLEPGTEYTIYVIALKNNQKSEPLIGRKKTDELPQLVTLPH
PNLHGPEILDVPSTVQKTPFVTHPGYDTGNGIQLPGTSGQQPSVGQQMIFEEHGFRRTTPPTTATPIRHRPRPYPPN
VGQEALSQTTISWAPFQDTSEYIISCHPVGTDEEPLQFRVPGTSTSATLTGLTRGATYNIIVEALKDQQRHKVREEV
VTVGNSVNEGLNQPTDDSCFDPYTVSHYAVGDEWERMSESGFKLLCQCLGFGSGHFRCDSSRWCHDNGVNYKIGEKW
DRQGENGQMMSCTCLGNGKGEFKCDPHEATCYDDGKTYHVGEQWQKEYLGAICSCTCFGGQRGWRCDNCRRPGGEPS
PEGTTGQSYNQYSQRYHQRTNTNVNCPIECFMPLDVQADREDSRE

Signal sequence.
amino acids 1-20

N-glycosylation sites.
amino acids 430-433, 528-531, 542-545, 877-880, 1007-1010, 1244-1247

Glycosaminoglycan attachment site.
amino acids 281-284 cAMP- and cGMP-dependent protein kinase phosphorylation sites.
amino acids 1988-1991, 2058-2061

Tyrosine kinase phosphorylation sites.
amino acids 155-163, 156-163

N-myristoylation sites.
amino acids 25-30, 51-56, 80-85, 127-132, 171-176, 262-267, 313-318, 337-342, 352-357, 353-358, 412-417, 413-418, 447-452, 500-505, 547-552, 670-675, 679-684, 873-878, 900-905, 966-971, 1080-1085, 1118-1123, 1142-1147, 1215-1220, 1240-1245, 1363-1368, 1442-1447, 1498-1503, 1507-1512, 1511-1516, 1601-1606, 1637-1642, 1691-1696, 1695-1700, 1716-1721, 1781-1786, 1806-1811, 1872-1877, 1954-1959, 1962-1967, 1966-1971, 2041-2046, 2121-2126, 2130-2135, 2134-2139, 2160-2165, 2240-2245, 2249-2254, 2283-2288, 2292-2297, 2316-2321

Amidation sites.
amino acids 437-440, 782-785, 1986-1989

Cell attachment sequence.
amino acids 1524-1526

FIGURE 147B

EGF-like domain cysteine pattern signatures.
amino acids 76-87, 2288-2299

Aldehyde dehydrogenases glutamic acid active site.
amino acids 1483-1490

Fibronectin type III domains.
amino acids 608-691, 720-800, 811-889, 907-986, 997-1075, 1087-1162, 1174-1256, 1267-1347, 1358-1437, 1448-1530, 1542-1621, 1632-1711, 1722-1801, 1814-1892, 1903-1982, 2073-2150

Fibronectin type I domains.
amino acids 52-87, 97-135, 141-179, 86-225, 231-270, 308-342, 470-508, 518-555, 561-599, 2175-2214, 2220-2257, 2264-2299

Fibronectin type II domains.
amino acids 360-401, 420-461

FIGURE 148

MKVSAALLCLLLIAATFIPQGLAQPDAINAPVTCCYNFTNRKISVQRLASYRRITSSKCPKEAVIFKTIVAKEICAD
PKQKWVQDSMDHLDKQTQTPKT

Signal sequence.
amino acids 1-23

N-glycosylation site.
amino acids 37-40 cAMP- and cGMP-dependent protein kinase phosphorylation sites.
amino acids 41-44, 52-55

Small cytokines (intecrine/chemokine) homology.
amino acids 24-90

FIGURE 149

MGLSTVPDLLLPLVLLELLVGIYPSGVIGLVPHLGDREKRDSVCPQGKYIHPQNNSICCTKCHKGTYLYNDCPGPGQ
DTDCRECESGSFTASENHLRHCLSCSKCRKEMGQVEISSCTVDRDTVCGCRKNQYRHYWSENLFQCFNCSLCLNGTV
HLSCQEKQNTVCTCHAGFFLRENECVSCSNCKKSLECTKLCLPQIENVKGTEDSGTTVLLPLVIFFGLCLLSLLFIG
LMYRYQRWKSKLYSIVCGKSTPEKEGELEGTTTKPLAPNPSFSPTPGFTPTLGFSPVPSSTFTSSSTYTPGDCPNFA
APRREVAPPYQGADPILATALASDPIPNPLQKWEDSAHKPQSLDTDDPATLYAVVENVPPLRWKEFVRRLGLSDHEI
DRLELQNGRCLREAQYSMLATWRRRTPRREATLELLGRVLRDMDLLGCLEDIEEALCGPAALPPAPSLLR

Transmembrane domain.
amino acids 210-230

Signal sequence.
amino acids 1-29

N-glycosylation sites.
amino acids 54-57, 145-148, 151-154 cAMP- and cGMP-dependent protein kinase phosphorylation sites.
amino acids 39-42, 408-411

Tyrosine kinase phosphorylation site.
amino acids 394-401

N-myristoylation sites.
amino acids 21-26, 87-92, 126-131, 204-209

Cytochrome c family heme-binding site signature.
amino acids 59-64

TNFR/NGFR cysteine-rich region.
amino acids 44-81, 84-125, 127-166, 168-195

Death domain.
amino acids 357-441

FIGURE 150

MWQIVFFTLSCDLVLAAAYNNFRKSMDSIGKKQYQVQHGSCSYTFLLPEMDNCRSSSSPYVSNAVQRDAPLEYDDSV
QRLQVLENIMENNTQWLMKLENYIQDNMKKEMVEIQQNAVQNQTAVMIEIGTNLLNQTAEQTRKLTDVEAQVLNQTT
RLELQLLEHSLSTNKLEKQILDQTSEINKLQDKNSFLEKKVLAMEDKHIIQLQSIKEEKDQLQVLVSKQNSIIEELE
KKIVTATVNNSVLQKQQHDLMETVNNLLTMMSTSNSAKDPTVAKEEQISFRDCAEVFKSGHTTNGIYTLTFPNSTEE
IKAYCDMEAGGGGWTIIQRREDGSVDFQRTWKEYKVGFGNPSGEYWLGNEFVSQLTNQQRYVLKIHLKDWEGNEAYS
LYEHFYLSSEELNYRIHLKGLTGTAGKISSISQPGNDFSTKDGDNDKCICKCSQMLTGGWWFDACGPSNLNGMYYPQ
RQNTNKFNGIKWYYWKGSGYSLKATTMMIRPADF

Signal sequence.
amino acids 1-16

N-glycosylation sites.
amino acids 89-92, 119-122, 133-135, 151-154, 240-243, 304-307 cAMP- and cGMP-dependent protein kinase phosphorylation site.
amino acids 140-143

N-myristoylation sites.
amino acids 319-324, 347-352, 405-410, 420-425, 479-484

Amidation site.
amino acids 29-32

Fibrinogen beta and gamma chains C-terminal domain signature.
amino acids 445-457

Fibrinogen beta and gamma chains, C-terminal homology.
amino acids 280-494

FIGURE 151A

MGALWSWWILWAGATLLWGLTQEASVDLKNTGREEFLTAFLQNYQLAYSKAYPRLLISSLSESPASVSILSQADNTS
KKVTVRPGESVMVNISAKAEMIGSKIFQHAVVIHSDYAISVQALNAKPDTAELTLLRPIQALGTEYFVLTPPGTSAR
NVKEFAVVAGAAGASVSVTLKGSVTFNGKFYPAGDVLRVTLQPYNVAQLQSSVDLSGSKVTASSPVAVLSGHSCAQK
HTTCNHVVEQLLPTSAWGTHYVVPTLASQSRYDLAFVVASQATKLTYNHGGITGSRGLQAGDVVEFEVRPSWPLYLS
ANVGIQVLLFGTGAIRNEVTYDPYLVLIPDVAAYCPAYVVKSVPGCEGVALVVAQTKAISGLTIDGHAVGAKLTWEA
VPGSEFSYAEVELGTADMIHTAEATTNLGLLTFGLAKAIGYATAADCGRTVLSPVEPSCEGMQCAAGQRCQVVGGKA
GCVAESTAVCRAQGDPHYTTFDGRRYDMMGTCSYTMVELCSEDDTLPAFSVEAKNEHRGSRRVSYVGLVTVRAYSHS
VSLTRGEVGFVLVDNQRSRLPVSLSEGRLRVYQSGPRAVVELVFGLVVTYDWDCQLALSLPARFQDQVCGLCGNYNG
DPADDFLTPDGALAPDAVEFASSWKLDDGDYLCEDGCQNNCPACTPGQAQHYEGDRLCGMLTKLDGPFAVCHDTLDP
RPFLEQCVYDLCVVGGERLSLCRGLSAYAQACLELGISVGDWRSPANCPLSCPANSRYELCGPACPTSCNGAAAPSN
CSGRPCVEGCVCLPGFVASGGACVPASSCGCTFQGLQLAPGQEVWADELCQRRCTCNGATHQVTCRDKQSCPAGERC
SVQNGLLGCYPDRFGTCQGSGDPHYVSFDGRRFDFMGTCTYLLVGSCGQNAALPAFRVLVENEHRGSQTVSYTRAVR
VEARGVKVAVRREYPGQVLVDDVLQYLPFQAADGQVQVFRQGRDAVVRTDFGLTVTYDWNARVTAKVPSSYAEALCG
LCGNFNGDPADDLALRGGGQAANALAFGNSWQEETRPGCGATEPGDCPKLDSLVAQQLQSKNECGILADPKGPFREC
HSKLDPQGAVRDCVYDRCLLPGQSGPLCDALATYAAACQAAGATVHPWRSEELCPLSCPPHSHYEACSYGCPLSCGD
LPVPGGCGSECHEGCVCDEGFALSGESCLPLASCGCVHQGTYHPPGQTFYPGPGCDSLCHCQEGGLVSCESSSCGPH
EACQPSGGSLGCVAVGSSTCQASGDPHYTTFDGRRFDFMGTCVYVLAQTCGTRPGLHRFAVLQENVAWGNGRVSVTR
VITVQVANFTLRLEQRQWKVTVNGVDMKLPVVLANGQIRASQHGSDVVIETDFGLRVAYDLVYYVRVTVPGNYYQQM
CGLCGNYNGDPKDDFQKPNGSQAGNANEFGNSWEEVVPDSPCLPPTPCPPGSEDCIPSHKCPPELEKKYQKEEFCGL
LSSPTGPLSSCHKLVDPQGPLKDCIFDLCLGGGNLSILCSNIHAYVSACQAAGGHVEPWRTETFCPMECPPNSHYEL
CADTCSLGCSALSAPPQCQDGCAEGCQCDSGFLYNGQACVPIQQCGCYHNGVYYEPEQTVLIDNCRQQCTCHAGKGM
VCQEHSCKPGQVCQPSGGILSCVTKDPCHGVTCRPQETCKEQGGQGVCLPNYEATCWLWGDPHYHSFDGRKFDFQGT
CNYVLATTGCPGVSTQGLTPFTVTTKNQNRGNPAVSYVRVVTVAALGTNISIHKDEIGKVRVNGVLTALPVSVADGR
ISVTQGASKALLVADFGLQVSYDWNWRVDVTLPSSYHGAVCGLCGNMDRNPNNDQVFPNGTLAPSIPIWGGSWRAPG
WDPLCWDECRGSCPTCPEDRLEQYEGPGFCGPLAPGTGGPFTTCHAHVPPESFFKGCVLDVCMGGGDRDILCKALAS
YVAACQAAGVVIEDWRAQVGCEITCPENSHYEVCGPPCPASCPSPAPLTTPAVCEGPCVEGCQCDAGFVLSADRCVP
LNNGCGCWANGTYHEAGSEFWADGTCSQWCRCGPGGGSLVCTPASCGLGEVCGLLPSGQHGCQPVSTAECQAWGDPH
YVTLDGHRFNFQGTCEYLLSAPCHGPPLGAENFTVTVANEHRGSQAVSYTRSVTLQIYNHSLTLSARWPRKLQVDGV
FVTLPFQLDSLLHAHLSGADVVVTTTSGLSLAFDGDSFVRLRVPAAYAGSLCGLCGNYNQDPADDLKAVGGKPAGWQ
VGGAQGCGECVSKPCPSPCTPEQQESFGGPDACGVISATDGPLAPCHGLVPPAQYFQGCLLDACQVQGHPGGLCPAV
ATYVAACQAAGAQLREWRRPDFCPFQCPAHSHYELCGDSCPGSCPSLSAPEGCESACREGCVCDAGFVLSGDTCVPV
GQCGCLHDDRYYPLGQTFYPGPGCDSLCRCREGGEVSCEPSSCGPHETCRPSGGSLGCVAVGSTTCQASGDPHYTTF
DGRRFDFMGTCVYVLAQTCGTRPGLHRFAVLQENVAWGNGRVSVTRVITVQVANFTLRLEQRQWKVTVNGVDMKLPV
VLANGQIRASQHGSDVVIETDFGLRVAYDLVYYVRVTVPGNYYQLMCGLCGNYNGDPKDDFQKPNGSQAGNANEFGN
SWEEVVPDSPCLPPPTCPPGSEGCIPSEECPPELEKKYQKEEFCGLLSSPTGPLSSCHKLVDPQGPLKDCIFDLCLG
GGNLSILCSNIHAYVSACQAAGGHVEPWRNETFCPMECPQNSHYELCADTCSLGCSALSAPLQCPDGCAEGCQCDSG
FLYNGQACVPIQQCGCYHNGAYYEPEQTVLIDNCRQQCTCHAGKVVVCQEHSCKPGQVCQPSGGILSCVTKDPCHGV
TCRPQETCKEQGGQGVCLPNYEATCWLWGDPHYHSFDGRKFDFQGTCNYVLATTGCPGVSTQGLTPFTVTTKNQNRG
NPAVSYVRVVTVAALGTNISIHKDEIGKVRVNGVLTALPVSVADGRISVAQGASKALLVADFGLQVSYDWNWRVDVT
LPSSYHGAVCGLCGNMDRNPNNDQVFPNGTLAPSIPIWGGSWRAPGWDPLCWDECRGSCPTCPEDRLEQYEGPGFCG
PLAPGTGGPFTTCHAHVPPESFFKGCVLDVCMGGGDHDILCKALASYVAACQAAGVVIEDWRAQVGCEITCPENSHY
EVCGPPCPASCPSPAPLTTPAVCEGPCVEGCQCDAGFVLSADRCVPLNNGCGCWANGTYHEAGSEFWADGTCSQWCR

FIGURE 151B

CGPGGGSLVCTPASCGLGEVCGLLPSGQHGCQPVSTAECQAWGDPHYVTLDGHRFDFQGTCEYLLSAPCHGPPLGAE
NFTVTVANEHRGSQAVSYTRSVTLQIYNHSLTLSARWPRKLQVDGVFVTLPFQLDSLLHAHLSGADVVVTTTSGLSL
AFDGDSFVRLRVPAAYAGSLCGLCGNYNQDPADDLKAVGGKPAGWQVGGAQGCGECVSKPCPSPCTPEQQESFGGPD
ACGVISATDGPLAPCHGLVPPAQYFQGCLLDACQVQGHPGGLCPAVATYVAACQAAGAQLREWRRPDFCPFQCPAHS
HYELCGDSCPGSCPSLSAPEGCESACREGCVCDAGFVLSGDTCVPVGQCGCLHDDRYYPLGQTFYPGPGCDSLCRCR
EGGEVSCEPSSCGPHETCRPSGGSLGCVAVGSTTCQASGDPHYTTFDGRRFDFMGTCVYVLAQTCGTRPGLHRFAVL
QENVAWGNGRVSVTRVITVQVANFTLRLEQRQWKVTVNGVDMKLPVVLANGQIRASQHGSDVVIETDFGLRVAYDLV
YYVRVTVPGNYYQLMCGLCGNYNGDPKDDFQKPNGSQAGNANEFGNSWEEVVPDSPCLPPPTCPPGSEGCIPSEECP
PELEKKYQKEEFCGLLSSPTGPLSSCHKLVDPQGPLKDCIFDLCLGGGNLSILCSNIHAYVSACQAAGGHVEPWRNE
TFCPMECPQNSHYELCADTCSLGCSALSAPLQCPDGCAEGCQCDSGFLYNGQACVPIQQCGCYHNGVYYEPEQTVLI
DNCRQQCTCHVGKVVVCQEHSCKPGQVCQPSGGILSCVNKDPCHGVTCRPQETCKEQGGQGVCLPNYEATCWLWGDP
HYHSFDGRKFDFQGTCNYVLATTGCPGVSTQGLTPFTVTTKNQNRGNPAVSYVRVVTVAALGTNISIHKDEIGKVRV
NGVLTALPVSVADGRISVAQGASKALLVADFGLQVSYDWNWRVDVTLPSSYHGAVCGLCGNMDRNPNNDQVFPNGTL
APSIPIWGGSWRAPGWDPLCWDECRGSCPTCPEDRLEQYEGPGFCGPLASGTGGPFTTCHAHVPPESFFKGCVLDVC
MGGGDHDILCKALASYVAACQAAGVVIEDWRAQVGCEITCPENSHYEVCGPPCPASCPSPAPLTTPAVCEGPCVEGC
QCDAGFVLSADRCVPLNNGCGCWANGTYHEAGSEFWADGTCSQWCRCGPGGGSLVCTPASCGLGEVCGLLPSGQHSC
QPVSTAECQAWGDPHYVTLDGHRFDFQGTCEYLLSAPCHGPPLGAENFTVTVANEHRGSQAVSYTRSVTLQIYNHSL
TLSARWPRKLQVDGVFVALPFQLDSLLHAHLSGADVVVTTTSGLSLAFDGDSFVRLRVPAAYAASLCGLCGNYNQDP
ADDLKAVGGKPAGWQVGGAQGCGECVSKPCPSPCTPEQQESFGGPDACGVISATDGPLAPCHGLVPPAQYFQGCLLD
ACQVQGHPGGLCPAVATYVAACQAAGAQLGEWRRPDFCPLQCPAHSHYELCGDSCPVSCPSLSAPEGCESACREGCV
CDAGFVLSGDTCVPVGQCGCLHDGRYYPLGEVFYPGPECERRCECGPGGHVTCQEGAACGPHEECRLEDGVQACHAT
GCGRCLANGGIHYITLDGRVYDLHGSCSYVLAQVCHPKPGDEDFSIVLEKNAAGHLQRLLVTVAGQVVSLAQGQQVT
VDGEAVALPVAVGRVRVTAEGRNMVLQTTKGLRLLFDGDAHLLMSIPSPFRGRLCGLCGNFNGNWSDDFVLPNGSAA
SSVETFGAAWRVPGSSKGCGEGCGPQGCPVCLAEETAPYESNEACGQLRNPQGPFATCQAVLSPSEYFRQCVYDLCA
QKGDKAFLCRSLAAYTAACQAAGVAVKPWRTDSFCPLHCPAHSHYSICTRTCQGSCAALSGLTGCTTRCFEGCECDD
RFLLSQGVCIPVQDCGCTHNGRYLPVNSSLLTSDCSERCSCSSSSGLTCQAAGCPPGRVCEVKAEARNCWATRGLCV
LSVGANLTTFDGARGATTSPGVYELSSRCPGLQNTIPWYRVVAEVQICHGKTEAVGQVHIFFQDGMVTLTPNKGVWV
NGLRVDLPAEKLASVSVSRTPDGSLLVRQKAGVQVWLGANGKVAVIVSNDHAGKLCGACGNFDGDQTNDWHDSQEKP
AMEKWRAQDFSPCYG

Transmembrane domain.
amino acids 407-427

Signal sequence.
amino acids 1-19

N-glycosylation sites.
amino acids 75-78, 91-94, 770-773, 1317-1320, 1405-1408, 1497-1500, 1743-1746, 1830-1833, 2012-2015, 2111-2114, 2138-2141, 2518-2521, 2606-2609, 2698-2701, 2725-2728, 2944-2947, 3031-3034, 3213-3216, 3312-3315, 3339-3342, 3719-3722, 3807-3810, 3899-3902, 3926-3929, 4145-4148, 4232-4235, 4414-4417, 4513-4516, 4540-4543, 4992-4995, 5001-5004, 5186-5189, 5242-5245

FIGURE 151C

Glycosaminoglycan attachment site.
amino acids 4285-4283 cAMP- and cGMP-dependent protein kinase phosphorylation sites.
amino acids 78-81, 523-526, 822-825

Tyrosine kinase phosphorylation sites.
amino acids 473-480, 641-647, 694-702, 1365-1372, 1365-1373, 2566-2573, 2566-2574, 3767-3774, 3767-3775

N-myristoylation sites.
amino acids 2-7, 164-169, 167-172, 211-216, 281-286, 282-287, 288-293, 321-326, 378-383, 388-393, 419-424, 446-451, 459-464, 584-589, 609-614, 612-617, 652-657, 729-734, 852-857, 862-867, 895-900, 929-934, 976-981, 1001-1006, 1004-1009, 1018-1023, 1019-1024, 1020-1025, 1039-1044, 1148-1153, 1160-1165, 1219-1224, 1220-1225, 1239-1244, 1240-1245, 1248-1253, 1283-1288, 1345-1350, 1363-1368, 1388-1393, 1391-1396, 1406-1411, 1437-1442, 1495-1500, 1561-1566, 1586-1591, 1634-1639, 1635-1640, 1661-1666, 1741-1746, 1758-1763, 1777-1782, 1788-1793, 1809-1814, 1813-1818, 1859-1864, 1886-1891, 1945-1950, 2008-2013, 2039-2044, 2055-2060, 2060-2065, 2155-2160, 2184-2189, 2205-2210, 2209-2214, 2226-2231, 2235-2240, 2236-2241, 2239-2244, 2261-2266, 2267-2272, 2305-2310, 2352-2357, 2362-2367, 2388-2393, 2420-2425, 2440-2445, 2441-2446, 2449-2454, 2484-2489, 2546-2551, 2564-2569, 2589-2594, 2592-2597, 2607-2612, 2638-2643, 2641-2646, 2696-2701, 2762-2767, 2787-2792, 2835-2840, 2836-2841, 2862-2867, 2942-2947, 2959-2964, 2978-2983, 2989-2994, 3010-3015, 3014-3019, 3060-3065, 3087-3092, 3146-3151, 3209-3214, 3240-3245, 3256-3261, 3261-3266, 3356-3361, 3385-3390, 3406-3411, 3410-3415, 3427-3432, 3436-3441, 3437-3442, 3440-3445, 3462-3467, 3468-3473, 3506-3511, 3553-3558, 3563-3568, 3589-3594, 3621-3626, 3641-3646, 3642-3647, 3650-3655, 3685-3690, 3747-3752, 3765-3770, 3790-3795, 3793-3798, 3808-3813, 3839-3844, 3842-3847, 3897-3902, 3963-3968, 3988-3993, 4036-4041, 4037-4042, 4063-4068, 4143-4148, 4160-4165, 4179-4184, 4190-4195, 4211-4216, 4215-4220, 4261-4266, 4288-4293, 4347-4352, 4410-4415, 4441-4446, 4457-4462, 4462-4467, 4557-4562, 4586-4591, 4611-4616, 4628-4633, 4637-4642, 4638-4643, 4641-4646, 4663-4668, 4669-4674, 4707-4712, 4723-4728, 4764-4769, 4790-4795, 4822-4827, 4844-4849, 4852-4857, 4916-4921, 4924-4929, 4984-4989, 4987-4992, 5002-5007, 5019-5024, 5023-5028, 5032-5037, 5136-5141, 5143-5148, 5175-5180, 5212-5217, 5240-5245, 5248-5253, 5267-5272, 5310-5315, 5370-5375, 5373-5378

Amidation sites.
amino acids 484-487, 876-879, 1264-1267, 1685-1688, 2465-2468, 2886-2889, 3666-3669, 4087-4090

FIGURE 151D

Leucine zipper patterns.
amino acids 1477-1498, 2678-2699, 3879-3900 von Willebrand factor type D domains.
amino acids 472-628, 864-1020, 1252-1407, 1673-1832, 2072-2228, 2453-2608, 2874-3033, 3273-3429, 3654-3809, 4075-4234, 4474-4630,4856-5003, 5235-5389

Trypsin Inhibitor like cysteine rich domains.
amino acids 745-799, 1136-1189, 1532-1585, 1950-2007, 2337-2390, 2733-2786, 3151-3208, 3538-3591, 3934-3987, 4352-4409, 4739-4792, 5121-5174

FIGURE 152

MARGSLRRLLRLLVLGLWLALLRSVAGEQAPGTAPCSRGSSWSADLDKCMDCASCRARPHSDFCLGCAAAPPAPFRL
LWPILGGALSLTFVLGLLSGFLVWRRCRRREKFTTPIEETGGEGCPAVALIQ

Signal sequence.
amino acids 1-24

Transmembrane domain.
amino acids 77-97

N-myristoylation sites.
amino acids 16-21, 32-37, 39-44, 83-88, 93-98

FIGURE 153

MLVLLAGIFVVHIATVIMLFVSTIANVWLVSNTVDASVGLWKNCTNISCSDSLSYASEDALKTVQAFMILSIIFCVI
ALLVFVFQLFTMEKGNRFFLSGATTLVCWLCILVGVSIYTSHYANRDGTQYHHGYSYILGWICFCFSFIIGVLYLVLRKK

Transmembrane domains.
amino acids 63-83, 97-117, 133-153

Signal sequence.
amino acids 1-25

N-glycosylation sites.
amino acids 43-46, 46-49

N-myristoylation site.
amino acids 39-44

PMP-22/EMP/MP20/Claudin family homology.
amino acids 1-151

FIGURE 154

MRSPRTRGRSGRPLSLLLALLCALRAKVCGASGQFELEILSMQNVNGELQNGNCCGGARNPGDRKCTRDECDTYFKV
CLKEYQSRVTAGGPCSFGSGSTPVIGGNTFNLKASRGNDRNRIVLPFSFAWPRSYTLLVEAWDSSNDTVQPDSIIEK
ASHSGMINPSRQWQTLKQNTGVAHFEYQIRVTCDDYYYGFGCNKFCRPRDDFFGHYACDQNGNKTCMEGWMGPECNR
AICRQGCSPKHGSCKLPGDCRCQYGWQGLYCDKCIPHPGCVHGICNEPWQCLCETNWGGQLCDKDLNYCGTHQPCLN
GGTCSNTGPDKYQCSCPEGYSGPNCEIAEHACLSDPCHNRGSCKETSLGFECECSPGWTGPTCSTNIDDCSPNNCSH
GGTCQDLVNGFKCVCPPQWTGKTCQLDANECEAKPCVNAKSCKNLIASYYCDCLPGWMGQNCDININDCLGQCQNDA
SCRDLVNGYRCICPPGYAGDHCERDIDECASNPCLNGGHCQNEINRFQCLCPTGFSGNLCQLDIDYCEPNPCQNGAQ
CYNRASDYFCKCPEDYEGKNCSHLKDHCRTTPCEVIDSCTVAMASNDTPEGVRYISSNVCGPHGKCKSQSGGKFTCD
CNKGFTGTYCHENINDCESNPCRNGGTCIDGVNSYKCICSDGWEGAYCETNINDCSQNPCHNGGTCRDLVNDFYCDC
KNGWKGKTCHSRDSQCDEATCNNGGTCYDEGDAFKCMCPGGWEGTTCNIARNSSCLPNPCHNGGTCVVNGESFTCVC
KEGWEGPICAQNTNDCSPHPCYNSGTCVDGDNWYRCECAPGFAGPDCRININECQSSPCAFGATCVDEINGYRCVCP
PGHSGAKCQEVSGRPCITMGSVIPDGAKWDDDCNTCQCLNGRIACSKVWCGPRPCLLHKGHSECPSGQSCIPILDDQ
CFVHPCTGVGECRSSSLQPVKTKCTSDSYYQDNCANITFTFNKEMMSPGLTTEHICSELRNLNILKNVSAEYSIYIA
CEPSPSANNEIHVAISAEDIRDDGNPIKEITDKIIDLVSKRDGNSSLIAAVAEVRVQRRPLKNRTDFLVPLLSSVLT
VAWICCLVTAFYWCLRKRRKPGSHTHSASEDNTTNNVREQLNQIKNPIEKHGANTVPIKDYENKNSKMSKIRTHNSE
VEEDDMDKHQQKARFAKQPAYTLVDREEKPPNGTPTKHPNWTNKQDNRDLESAQSLNRMEYIV

Transmembrane domain.

amino acids 1067-1087

Signal sequence.

amino acids 1-26

N-glycosylation sites.

amino acids 143-146, 217-320, 382-385, 559-562, 745-748, 960-963, 991-994, 1045-1048, 1064-1067, 1110-1113, 1195-1198 cAMP- and cGMP-dependent protein kinase phosphorylation site.

amino acids 64-67

Tyrosine kinase phosphorylation sites.

amino acids 184-191, 184-192, 947-654

N-myristoylation sites.

amino acids 52-57, 89-94, 104-109, 114-119, 216-221, 270-275, 289-294, 309-314, 310-315, 456-461, 610-616, 733-738, 737-742, 932-937

Aspartic acid and asparagine hydroxylation sites.

amino acids 389-400, 427-438, 464-475, 502-513, 540-551, 644-655, 682-693, 720-731, 797-808, 835-844

EGF-like domain cysteine pattern signature.

amino acids 251-262, 282-293, 322-333, 360-371, 398-409, 436-447, 473-484, 511-522, 549-560, 615-626, 653-564, 691-702, 729-740, 768-779, 806-817, 844-855

EGF-like domains.

amino acids 187-229, 234-262, 265-293, 300-333, 340-371, 378-409, 416-447, 454-484, 491-522, 529-560, 595-626, 633-664, 671-702, 709-740, 748-779, 786-817, 824-855

Delta serrate ligand homology.

amino acids 167-229

FIGURE 155

GQKGERGLPGLQGVIGFPGMQGPEGPQGPPGQKGDTGEPGLPGTKGTRGPPGASGYPGNPGLPGIPGQDGPPGPPGI
PGCNGTKGERGPLGPPGLPGFAGNPGPPGLPGMKGDPGEILGHVPGMLLKGERGFPGIPGTPGPPGLPGLQGPVGPP
GFTGPPGPPGPPGPPGEKGQMGLSFQGPKGDKGDQGVSGPPGVPGQAQVQEKGDFATKGEKGQKGEPGFQGMPGVGE
KGEPGKPGPRGKPGKDGDKGEKGSPGFPGEPGYPGLIGRQGPQGEKGEAGPPGPPGIVIGTGPLGEKGERGYPGTPG
PRGEPGPKGFPGLPGQPGPPGLPVPGQAGAPGFPGERGEKGDRGFPGTSLPGPSGRDGLPGPPGSPGPPGQPGYTNG
IVECQPGPPGDQGPPGIPGQPGFIGEIGEKGQKGESCLICDIDGYRGPPGPQGPPGEIGFPGQPGAKGDRGLPGRDG
VAGVPGPQGTPGLIGQPGAKGEPGEFYFDLRLKGDKGDPGFPGQPGMPGRAGSPGRDGHPGLPGPKGSPGSVGLKGE
RGPPGGVGFPGSRGDTGPPGPPGYGPAGPIGDKGQAGFPGGPGSPGLPGPKGEPGKIVPLPGPPGAEGLPGSPGFPG
PQGDRGFPGTPGRPGLPGEKGAVGQPGIGFPGPPGPKGVDGLPGDMGPPGTPGRPGFNGLPGNPGVQGQKGEPGVGL
PGLKGLPGLPGIPGTPGEKGSIGVPGVPGEHGAIGPPGLQGIRGEPGPPGLPGSVGSPGVPGIGPPGARGPPGGQGP
PGLSGPPGIKGEKGFPGFPGLDMPGPKGDKGAQGLPGITGQSGLPGLPGQQGAPGIPGFPGSKGEMGVMGTPGQPGS
PGPWGAPGLPGEKGDHGFPGSSGPRGDPGLKGDKGDVGLPGKPGSMDKVDMGSMKGQKGDQGEKGQIGPIGEKGSRG
DPGTPGVPGKDGQAGQPGQPGPKGDPGISGTPGAPGLPGPKGSVGGMGLPGTPGEKGVPGIPGPQGSPGLPGDKGAK
GEKGQAGPPGIGIPGLRGEKGDQGIAGFPGSPGEKGEKGSIGIPGMPGSPGLKGSPGSVGYPGSPGLPGEKGDKGLP
GLDGIPGVKGEAGLPGTPGPTGPAGQKGEPGSDGIPGSAGEKGEPGLPGRGFPGFPGAKGDKGSKGEVGFPGLAGSP
GIPGSKGEQGFMGPPGPQGQPGLPGSPGHATEGPKGDRGPQGQPGLPGLPGPMGPPG

N-glycosylation site.
amino acids 81-84

N-myristoylation sites.
amino acids 40-45, 43-48, 76-81, 79-84, 287-292, 385-390, 447-452, 477-482, 529-534, 743-748, 899-904, 966-971, 1055-1060, 1112-1117, 1156-1161

Cell attachment sequence.
amino acids 552-554, 872-874, 923-925

Collagen triple helix repeat (20 copies).
amino acids 1-60, 61-120, 143-201, 233-292, 293-351, 363-421, 427-485, 502-561, 564-624, 628-686, 695-754, 769-827, 831-890, 898-956, 957-1016, 1019-1078, 1088-1146, 1153-1211

FIGURE 156

GERGPPGSPGLQGFPGITPPSNISGAPGDKGAPGIFGLKGYRGPPGPPGSAALPGSKGDTGNPGAPGTPGTKGWAGD
SGPQGRPGVFGLPGEKGPRGEQGFMGNTGPTGAVGDRGPKGPKGDPGFPGAPGTVGAPGIAGIPQKIAIQPGTVGPQ
GRRGPPGAPGEIGPQGPPGEPGFRGAPGKAGPQGRGGVSAVPGFRGDEGPIGHQGPIGQEGAPGRPGSPGLPGMPGR
SVSIGYLLVKHSQTDQEPMCPVGMNKLWSGYSLLYFEGQEKAHNQDLGLAGSCLARFSTMPFLYCNPGDVCYYASRN
DKSYWLSTTAPLPMMPVAEDEIKPYISRCSVCEAPAIAIAVHSQDVSIPHCPAGWRSLWIGYSFLMHTAAGDEGGGQ
SLVSPGSCLEDFRATPFIECNGGRGTCHYYANKYSFWLTTIPEQSFQGSPSADTLKAGLIRTHISRCQVCMKNL

N-glycosylation site.
amino acids 22-25

N-myristoylation sites.
amino acids 67-72, 127-132, 190-195, 269-274, 279-284, 282-287, 382-387, 407-412, 433-438, 443-448

Amidation site.
amino acids 154-157

Cell attachment sequence.
amino acids 199-201

C-terminal tandem repeated domain in type 4.
amino acids 236-343, 344-458

Collagen Collagen triple helix repeat (20 copies).
amino acids 25-84, 88-147, 152-211

FIGURE 157

MFSFVDLRLLLLLAATALLTHGQEEGQVEGQDEDIPPITCVQNGLRYHDRDVWKPEPCRICVCDNGKVLCDDVICDE
TKNCPGAEVPEGECCPVCPDGSESPTDQETTGVEGPKGDTGPRGPRGPAGPPGRDGIPGQPGLPGPPGPPGPPGPPG
LGGNFAPQLSYGYDEKSTGGISVPGPMGPSGPRGLPGPPGAPGPQGFQGPPGEPGEPGASGPMGPRGPPGPPGKNGD
DGEAGKPGRPGERGPPGPQGARGLPGTAGLPGMKGHRGFSGLDGAKGDAGPAGPKGEPGSPGENGAPGQMGPRGLPG
ERGRPGAPGPAGARGNDGATGAAGPPGPTGPAGPPGFPGAVGAKGEAGPQGPRGSEGPQGVRGEPGPPGPAGAAGPA
GNPGADGQPGAKGANGAPGIAGAPGFPGARGPSGPQGPGGPPGPKGNSGEPGAPGSKGDTGAKGEPGPVGVQGPPGP
AGEEGKRGARGEPGPTGLPGPPGERGGPGSRGFPGADGVAGPKGPAGERGSPGPAGPKGSPGEAGRPGEAGLPGAKG
LTGSPGSPGPDGKTGPPGPAGQDGRPGPPGPPGARGQAGVMGFPGPKGAAGEPGKAGERGVPGPPGAVGPAGKDGEA
GAQGPPGPAGPAGERGEQGPAGSPGFQGLPGPAGPPGEAGKPGEQGVPGDLGAPGPSGARGERGFPGERGVQGPPGP
AGPRGANGAPGNDGAKGDAGAPGAPGSQGAPGLQGMPGERGAAGLPGPKGDRGDAGPKGADGSPGKDGVRGLTGPIG
PPGPAGAPGDKGESGPSGPAGPTGARGAPGDRGEPGPPGPAGFAGPPGADGQPGAKGEPGDAGAKGDAGPPGPAGPA
GPPGPIGNVGAPGAKGARGSAGPPGATGFPGAAGRVGPPGPSGNAGPPGPPGPAGKEGGKGPRGETGPAGRPGEVGP
PGPPGPAGEKGSPGADGPAGAPGTPGPQGIAGQRGVVGLPGQRGERGFPGLPGPSGEPGKQGPSGASGERGPPGPMG
PPGLAGPPGESGREGAPAAEGSPGRDGSPGAKGDRGETGPAGPPGAPGAPGAPGPVGPAGKSGDRGETGPAGPAGPV
GPVGARGPAGPQGPRGDKGETGEQGDRGIKGHRGFSGLQGPPGPPGSPGEQGPSGASGPAGPRGPPGSAGAPGKDGL
NGLPGPIGPPGPRGRTGDAGPVGPPGPPGPPGPPGPPSAGFDFSFLPQPPQEKAHDGGRYYRADDANVVRDRDLEVD
TTLKSLSQQIENIRSPEGSRKNPARTCRDLKMCHSDWKSGEYWIDPNQGCNLDAIKVFCNMETGETCVYPTQPSVAQ
KNWYISKNPKDKRHVWFGESMTDGFQFEYGGQGSDPADVAIQLTFLRLMSTEASQNITYHCKNSVAYMDQQTGNLKK
ALLLKGSNEIEIRAEGNSRFTYSVTVDGCTSHTGAWGKTVIEYKTTKSSRLPIIDVAPLDVGAPDQEFGFDVGPVCFL

Signal sequence.

amino acids 1-22

N-glycosylation site.

amino acids 1365-1368

Tyrosine kinase phosphorylation site.

amino acids 1208-1217

N-myristoylation sites.

amino acids 22-27, 26-31, 154-159, 254-259, 272-277, 320-325, 323-328, 326-331, 347-352, 386-391, 392-397, 395-400, 437-442, 488-493, 533-538, 701-706, 704-709, 716-721, 821-826, 857-862, 860-865, 863-868, 935-940, 1016-1021, 1028-1033, 1339-1344, 1342-1347

Amidation site.

amino acids 466-469

Cell attachment sequences.

amino acids 745-747, 1093-1095

Collagen triple helix repeats.

amino acids 107-165, 177-235, 236-295, 296-355, 356-415, 416-475, 476-535, 536-595, 596-655, 656-715, 716-775, 779-838, 839-898, 899-958, 959-1018, 1020-1078, 1079-1138, 1139-1198

Fibrillar collagen C-terminal domain.

amino acids 1245-1463 von Willebrand factor type C domain.

amino acids 40-95

FIGURE 158

MLSFVDTRTLLLLAVTLCLATCQSLQEETVRKGPAGDRGPRGERGPPGPPGRDGEDGPTGPPGPPGPPGPPGLGGNF
AAQYDGKGVGLGPGPMGLMGPRGPPGAAGAPGPQGFQGPAGEPGEPGQTGPAGARGPAGPPGKAGEDGHPGKPGRPG
ERGVVGPQGARGFPGTPGLPGFKGIRGHNGLDGLKGQPGAPGVKGEPGAPGENGTPGQTGARGLPGERGRVGAPGPA
GARGSDGSVGPVGPAGPNGSAGPPGFPGAPGPKGEIGAVGNAGPTGPAGPRGEVGLPGLSGPVGPPGNPGANGLTGA
KGAAGLPGVAGAPGLPGPRGIPGPPGAAGTTGARGLVGEPGPAGSKGESGNKGEPGSAGPQGPPGPSGEEGKRGPNG
EAGSAGPPGPPGLRGSPGSRGLPGADGRAGVMGPPGSRGASGPAGVRGPNGDAGRPGEPGLMGPRGLPGSPGNIGPA
GKEGPVGLPGIDGRPGPIGPVGARGEPGNIGFPGPKGPTGDPGKNGDKGHAGLAGARGAPGPDGNNGAQGPPGPQGV
QGGKGEQGPAGPPGFQGLPGPSGPAGEVGKPGERGLHGEFGLPGPAGPRGERGPPGESGAAGPTGPIGSRGPSGPPG
PDGNKGEPGVVGAVGTAGPSGPSGLPGERGAAGIPGGKGEKGEPGLRGEIGNPGRDGARGAHGAVGAPGPAGATGDR
GEAGAAGPAGPAGPRGSPGERGEVGPAGPNGFAGPAGAAGQPGAKGERGGKGPKGENGVVGPTGPVGAAGPAGPNGP
PGPAGSRGDGGPPGMTGFPGAAGRTGPPGPSGISGPPGPPGPAGKEGLRGPRGDQGPVGRTGEVGAVGPPGFAGEKG
PSGEAGTAGPPGTPGPQGLLGAPGILGLPGSRGERGLPGVAGAVGEPGPLGIAGPPGARGPPGAVGSPGVNGAPGEA
GRDGNPGNDGPPGRDGQPGHKGERGYPGNIGPVGAAGAPGPHGPVGPAGKHGNRGETGPSGPVGPAGAVGPRGPSGP
QGIRGDKGEPGEKGPRGLPGFKGHNGLQGLPGIAGHHGDQGAPGSVGPAGPRGPAGPSGPAGKDGRTGHPGTVGPAG
IRGPQGHQGPAGPPGPPGPPGPPGVSGGGYDFGYDGDFYRADQPRSAPSLRPKDYEVDATLKSLNNQIETLLTPEGS
RKNPARTCRDLRLSHPEWSSGYYWIDPNQGCTMEAIKVYCDFPTGETCIRAQPENIPAKNWYRSSKDKKHVWLGETI
NAGSQFEYNVEGVTSKEMATQLAFMRLLANYASQNITYHCKNSIAYMDEETGNLKKAVILQGSNDVELVAEGNSRFT
YTVLVDGCSKKTNEWGKTIIEYKTNKPSRLPFLDIAPLDIGGADHEFFVDIGPVCFK

Signal sequence.
amino acids 1-22
N-glycosylation sites.
amino acids 249-252, 1267-1370
Glycosaminoglycan attachment site.
amino acids 1104-1107
N-myristoylation sites.
amino acids 72-77, 74-79, 75-80, 211-216, 232-237, 235-240, 268-273, 298-303, 304-309, 307-312, 334-339, 337-342, 400-405, 406-411, 421-426, 454-459, 514-519, 526-531, 538-543, 625-630, 628-633, 649-654, 673-678, 676-681, 733-738, 780-785, 874-879, 886-891, 928-933, 1042-1047, 1102-1107
Amidation site.
amino acids 378-381
Cell attachment sequences.
amino acids 777-779, 822-824, 1005-1007
Collagen triple helix repeats.
amino acids 25-83, 89-147, 148-207, 208-267, 268-327, 328-387, 388-447, 448-507, 508-567, 568-627, 628-687, 691-750, 751-810, 811-870, 871-930, 931-990, 991-1050, 1051-1110
Fibrillar collagen C-terminal domain.
amino acids 1149-1365

FIGURE 159

MMSFVQKGSWLLLALLHPTIILAQQEAVEGGCSHLGQSYADRDVWKPEPCQICVCDSGSVLCDDIICDDQELDCPNP
EIPFGECCAVCPQPPTAPTRPPNGQGPQGPKGDPGPPGIPGRNGDPGIPGQPGSPGSPGPPGICESCPTGPQNYSPQ
YDSYDVKSGVAVGGLAGYPGPAGPPGPPGPPGTSGHPGSPGSPGYQGPPGEPGQAGPSGPPGPPGAIGPSGPAGKDG
ESGRPGRPGERGLPGPPGIKGPAGIPGFPGMKGHRGFDGRNGEKGETGAPGLKGENGLPGENGAPGPMGPRGAPGER
GRPGLPGAAGARGNDGARGSDGQPGPPGPPGTAGFPGSPGAKGEVGPAGSPGSNGAPGQRGEPGPQGHAGAQGPPGP
PGINGSPGGKGEMGPAGIPGAPGLMGARGPPGPAGANGAPGLRGGAGEPGKNGAKGEPGPRGERGEAGIPGVPGAKG
EDGKDGSPGEPGANGLPGAAGERGAPGFRGPAGPNGIPGEKGPAGERGAPGPAGPRGAAGEPGRDGVPGGPGMRGMP
GSPGGPGSDGKPGPPGSQGESGRPGPPGPSGPRGQPGVMGFPGPKGNDGAPGKNGERGGPGGPGPQGPPGKNGETGP
QGPPGPTGPGGDKGDTGPPGPQGLQGLPGTGGPPGENGKPGEPGPKGDAGAPGAPGGKGDAGAPGERGPPGLAGAPG
LRGGAGPPGPEGGKGAAGPPGPPGAAGTPGLQGMPGERGGLGSPGPKGDKGEPGGPGADGVPGKDGPRGPTGPIGPP
GPAGQPGDKGEGGAPGLPGIAGPRGSPGERGETGPPGPAGFPGAPGQNGEPGGKGERGAPGEKGEGGPPGVAGPPGG
SGPAGPPGPQGVKGERGSPGGPGAAGFPGARGLPGPPGSNGNPGPPGPSGSPGKDGPPGPAGNTGAPGSPGVSGPKG
DAGQPGEKGSPGAQGPPGAPGPLGIAGITGARGLAGPPGMPGPRGSPGPQGVKGESGKPGANGLSGERGPPGPQGLP
GLAGTAGEPGRDGNPGSDGLPGRDGSPGGKGDRGENGSPGAPGAPGHPGPPGPVGPAGKSGDRGESGPAGPAGAPGP
AGSRGAPGPQGPRGDKGETGERGAAGIKGHRGFPGNPGAPGSPGPAGQQGAIGSPGPAGPRGPVGPSGPPGKDGTSG
HPGPIGPPGPRGNRGERGSEGSPGHPGQPGPPGPPGAPGPCCGGVGAAAIAGIGGEKAGGFAPYYGDEPMDFKINTD
EIMTSLKSVNGQIESLISPDGSRKNPARNCRDLKFCHPELKSGEYWVDPNQGCKLDAIKVFCNMETGETCISANPLN
VPRKHWWTDSSAEKKHVWFGESMDGGFQFSYGNPELPEDVLDVQLAFLRLLSSRASQNITYHCKNSIAYMDQASGNV
KKALKLMGSNEGEFKAEGNSKFTYTVLEDGCTKHTGEWSKTVFEYRTRKAVRLPIVDIAPYDIGGPDQEFGVDVGPVCFL

Signal sequence.
amino acids 1-23
N-glycosylation site.
amino acids 1367-1370
N-myristoylation sites.
amino acids 36-41, 58-63, 139-144, 163-168, 167-172, 312-317, 315-320, 318-323, 321-326, 324-329, 345-350, 357-362, 390-395, 408-413, 426-431, 456-461, 477-482, 543-548, 626-631, 642-647, 647-652, 669-674, 693-698, 705-710, 747-752, 782-787, 847-852, 867-872, 933-938, 951-956, 1002-1007, 1014-1019, 1026-1031, 1125-1130, 1198-1203, 1199-1204, 1209-1214, 1243-1248, 1394-1399
Cell attachment sequence.
amino acids 1091-1093
Collagen triple helix repeats.
amino acids 82-141, 168-227, 234-293, 294-353, 354-413, 414-473, 474-533, 534-593, 594-653, 654-713, 714-773, 777-836, 837-896, 897-956, 957-1016, 1017-1076, 1077-1136, 1137-1196
Fibrillar collagen C-terminal domain.
amino acids 1248-1465

FIGURE 160A

MRKHRHLPLVAVFCLFLSGFPTTHAQQQQADVKNGAAADIIFLVDSSWTIGEEHFQLVREFLYDVVKSLAVGENDFH
FALVQFNGNPHTEFLLNTYRTKQEVLSHISNMSYIGGTNQTGKGLEYIMQSHLTKAAGSRAGDGVPQVIVVLTDGHS
KDGLALPSAELKSADVNVFAIGVEDADEGALKEIASEPLNMHMFNLENFTSLHDIVGNLVSCVHSSVSPERAGDTET
LKDITAQDSADIIFLIDGSNNTGSVNFAVILDFLVNLLEKLPIGTQQIRVGVVQFSDEPRTMFSLDTYSTKAQVLGA
VKALGFAGGELANIGLALDFVVENHFTRAGGSRVEEGVPQVLVLISAGPSSDEIRYGVVALKQASVFSFGLGAQAAS
RAELQHIATDDNLVFTVPEFRSFGDLQEKLLPYIVGVAQRHIVLKPPTIVTQVIEVNKRDIVFLVDGSSALGLANFN
AIRDFIAKVIQRLEIGQDLIQVAVAQYADTVRPEFYFNTHPTKREVITAVRKMKPLDGSALYTGSALDFVRNNLFTS
SAGYRAAEGIPKLLVLITGGKSLDEISQPAQELKRSSIMAFAIGNKGADQAELEEIAFDSSLVFIPAEFRAAPLQGM
LPGLLAPLRTLSGTPEVHSNKRDIIFLLDGSANVGKTNFPYVRDFVMNLVNSLDIGNDNIRVGLVQFSDTPVTEFSL
NTYQTKSDILGHLRQLQLQGGSGLNTGSALSYVYANHFTEAGGSRIREHVPQLLLLLTAGQSEDSYLQAANALTRAG
ILTFCVGASQANKAELEQIAFNPSLVYLMDDFSSLPALPQQLIQPLTTYVSGGVEEVPLAQPESKRDILFLFDGSAN
LVGQFPVVRDFLYKIIDELNVKPEGTRIAVAQYSDDVKVESRFDEHQSKPEILNLVKRMKIKTGKALNLGYALDYAQ
RYIFVKSAGSRIEDGVLQFLVLLVAGRSSDRVDGPASNLKQSGVVPFIFQAKNADPAELEQIVLSPAFILAAESLPK
IGDLHPQIVNLLKSVHNGAPAPVSGEKDVVFLLDGSEGVRSGFPLLKEFVQRVVESLDVGQDRVRVAVVQYSDRTRP
EFYLNSYMNKQDVVNAVRQLTLLGGPTPNTGAALEFVLRNILVSSAGSRITEGVPQLLIVLTADRSGDDVRNPSVVV
KRGGAVPIGIGIGNADITEMQTISFIPDFAVAIPTFRQLGTVQQVISERVTQLTREELSRLQPVLQPLPSPGVGGKR
DVVFLIDGSQSAGPEFQYVRTLIERLVDYLDVGFDTTRVAVIQFSDDPKAEFLLNAHSSKDEVQNAVQRLRPKGGRQ
INVGNALEYVSRNIFKRPLGSRIEEGVPQFLVLISSGKSDDEVVVPAVELKQFGVAPFTIARNADQEELVKISLSPE
YVFSVSTFRELPSLEQKLLTPITTLTSEQIQKLLASTRYPPPAVESDAADIVFLIDSSEGVRPDGFAHIRDFVSRIV
RRLNIGPSKVRVGVVQFSNDVFPEFYLKTYRSQAPVLDAIRRLRLRGGSPLNTGKALEFVARNLFVKSAGSRIEDGV
PQHLVLVLGGKSQDDVSRFAQVIRSSGIVSLGVGDRNIDRTELQTITNDPRLVFTVREFRELPNIEERIMNSFGPSA
ATPAPPGVDTPPPSRPEKKKADIVFLLDGSINFRRDSFQEVLRFVSEIVDTVYEDGDSIQVGLVQYNSDPTDEFFLK
DFSTKRQIIDAINKVVYKGGRHANTKVGLEHLRVNHFVPEAGSRLDQRVPQIAFVITGGKSVEDAQDVSLALTQRGV
KVFAVGVRNIDSEEVGKIASNSATAFRVGNVQELSELSEQVLETLHDAMHETLCPGVTDAAKACNLDVILGFDGSRD
QNVFVAQKGFESKVDAILNRISQMHRVSCSGGRSPTVRVSVVANTPSGPVEAFDFDEYQPEMLEKFRNMRSQHPYVL
TEDTLKVYLNKFRQSSPDSVKVVIHFTDGADGDLADLHRASENLRQEGVRALILVGLERVVNLERLMHLEFGRGFMY
DRPLRLNLLDLDYELAEQLDNIAEKACCGVPCKCSGQRGDRGPIGSIGPKGIPGEDGYRGYPGDEGGPGERGPPGVN
GTQGFQGCPGQRGVKGSRGFPGEKGEVGEIGLDGLDGEDGDKGLPGSSGEKGNPGRRGDKGPRGEKGERGDVGIRGD
PGNPGQDSQERGPKGETGDLGPMGVPGRDGVPGGPGETGKNGGFGRRGPPGAKGNKGGPGQPGFEGEQGTRGAQGPA
GPAGPPGLIGEQGISGPRGSGGARGAPGERGRTGPLGRKGEPGEPGPKGGIGNPGPRGETGDDGRDGVGSEGRRGKK
GERGFPGYPGPKGNPGEPGLNGTTGPKGIRGRRGNSGPPGIVGQKGRPGYPGPAGPRGNRGDSIDQCALIQSIKDKC
PCCYGPLECPVFPTELAFALDTSEGVNQDTFGRMRDVVLSIVNVLTIAESNCPTGARVAVVTYNNEVTTEIRFADSK
RKSVLLDKIKNLQVALTSKQQSLETAMSFVARNTFKRVRNGFLMRKVAVFFSNTPTRASPQLREAVLKLSDAGITPL
FLTRQEDRQLINALQINNTAVGHALVLPAGRDLTDFLENVLTCHVCLDICNIDPSCGFGSWRPSFRDRRAAGSDVDI
DMAFILDSAETTTLFQFNEMKKYIAYLVRQLDMSPDPKASQHFARVAVVQHAPSESVDNASMPPVKVEFSLTDYGSK
EKLVDFLSRGMTQLQGTRALGSAIEYTIENVFESAPNPRDLKIVVLMLTGEVPEQQLEEAQRVILQAKCKGYFFVVL
GIGRKVNIKEVYTFASEPNDVFFKLVDKSTELNEEPLMRFGRLLPSFVSSENAFYLSPDIRKQCDWFQGDQPTKNLV
KFGHKQVNVPNNVTSSPTSNPVTTTKPVTTTKPVTTTTKPVTTTTKPVTIINQPSVKPAAAKPAPAKPVAAKPVATK
TATVRPPVAVKPATAAKPVAAKPAAVRPPAAAAKPVATKPEVPRPQAAKPAATKPATTKPVVKMLREVQVFEITENS
AKLHWERPEPPGPYFYDLTVTSAHDQSLVLKQNLTVTDRVIGGLLAGQTYHVAVVCYLRSQVRATYHGSFSTKKSQP
PPPQPARSASSSTINLMVSTEPLALTETDICKLPKDEGTCRDFILKWYYDPNTKSCARFWYGGCGGNENKFGSQKEC
EKVCAPVLAKPGVISVMGT

Transmembrane domains.
amino acids 306-326, 934-954
Signal sequence.
amino acids 1-25
N-glycosylation sites.
amino acids 108-111, 116-119, 202-205, 251-254, 2079-2082, 2331-2334, 2558-2561, 2677-2680, 2861-2864, 3036-3039
cAMP- and cGMP-dependent protein kinase phosphorylation sites.
amino acids 573-576, 1651-1654, 2464-2467
N-myristoylation sites.
amino acids 85-90, 114-119, 135-140, 176-181, 211-216, 249-254, 307-312, 316-321, 380-385, 583-588, 586-591, 615-620, 714-719, 716-721, 720-725, 777-782, 872-877, 1039-1044, 1125-1130, 1164-1169, 1166-1171, 1240-1245, 1511-1516, 1713-1718, 1827-1832, 2077-2082, 2092-2097, 2122-2127, 2207-2212, 2225-2230, 2252-2257, 2254-2259, 2329-2334, 2442-2447, 3045-3050, 3046-3051, 3071-3076, 3142-3147, 3143-3148, 3145-3150
Amidation sites.
amino acids 1229-1232, 2133-2136, 2200-2203, 2269-2272, 2304-2307, 2307-2310, 2340-2343, 2774-2777

FIGURE 160B

Cell attachment sequence.
amino acids 2040-2042, 2136-2138, 2148-2150, 2154-2156, 2370-2372
ATP/GTP-binding site motif A (P-loop).
amino acids 646-653
Pancreatic trypsin inhibitor (Kunitz) family signature.
amino acids 3139-3157
von Willebrand factor type A domains.
amino acids 39-213, 242-415, 445-620, 639-812, 837-1009, 1029-1201, 1233-1404, 1436-1609, 1639-1812, 2402-2581, 2619-2810
Collagen triple helix repeats.
amino acids 2038-2097, 2104-2163, 2174-2233, 2234-2293, 2314-2373
Kunitz/Bovine pancreatic trypsin inhibitor.
amino acids 3111-3161

FIGURE 161

MRVTLATIAWMVSFVSNYSHTANILPDIENEDFIKDCVRIHNKFRSEVKPTASDMLYMTWDPALAQIAKAWASNCQF
SHNTRLKPPHKLHPNFTSLGENIWTGSVPIFSVSSAITNWYDEIQDYDFKTRICKKVCGHYTQVVWADSYKVGCAVQ
FCPKVSGFDALSNGAHFICNYGPGGNYPTWPYKRGATCSACPNNDKCLDNLCVNRQRDQVKRYYSVVYPGWPIYPRN
RYTSLFLIVNSVILILSVIITILVQLKYPNLVLLD

N-glycosylation sites.
amino acids 17-20, 92-95

N-myristoylation sites.
amino acids 179-184, 189-194

Extracellular proteins SCP/Tpx-1/Ag5/PR-1/Sc7 signature 1.
amino acids 136-146

FIGURE 162

MDVHTRWKARSALRPGAPLLPPLLLLLLWAPPPSRAAQPADLLKVLDFHNLPDGITKTTGFCATRRSSKGPDVAYRV
TKDAQLSAPTKQLYPASAFPEDFSILTTVKAKKGSQAFLVSIYNEQGIQQIGLELGRSPVFLYEDHTGKPGPEDYPL
FRGINLSDGKWHRIALSVHKKNVTLILDCKKKTTKFLDRSDHPMIDINGIIVFGTRILDEEVFEGDIQQLLFVSDHR
AAYDYCEHYSPDCDTAVPDTPQSQDPNPDEYYTEGDGEGETYYYEYPYYEDPEDLGKEPTPSKKPVEAAKETTEVPE
ELTPTPTEAAPMPETSEGAGKEEDVGIGDYDYVPSEDYYTPSPYDDLTYGEGEENPDQPTDPGAGAEIPTSTADTSN
SSNPAPPPGEGADDLEGEFTEETIRNLDENYYDPYYDPTSSPSEIGPGMPANQDTIYEGIGGPRGEKGQKGEPAIIE
PGMLIEGPPGPEGPAGLPGPPGTMGPTGQVGDPGERGPPGRPGLPGADGLPGPPGTMLMLPFRFGGGGDAGSKGPMV
SAQESQAQAILQQARLALRGPAGPMGLTGRPGPVGPPGSGGLKGEPGDVGPQGPRGVQGPPGPAGKPGRRGRAGSDG
ARGMPGQTGPKGDRGFDGLAGLPGEKGHRGDPGPSGPPGPPGDDGERGDDGEVGPRGLPGKPGPRGLLGPKGPPGPP
GPPGVTGMDGQPGPKGNVGPQGEPGPPGQQGNPGAQGLPGPQGAIGPPGEKGPLGKPGLPGMPGADGPPGHPGKEGP
PGEKGGQGPPGPQGPIGYPGPRGVKGADGIRGLKGTKGEKGEDGFPGFKGDMGIKGDRGEIGPPGPRGEDGPEGPKG
RGGPNGDPGPLGPPGEKGKLGVPGLPGYPGRQGPKGSIGFPGFPGANGEKGGRGTPGKPGPRGQRGPTGPRGERGPR
GITGKPGPKGNSGGDGPAGPPGERGPNGPQGPTGFPGPKGPPGPPGKDGLPGHPGQRGETGFQGKTGPPGPPGVVGP
QGPTGETGPMGERGHPGPPGPPGEQGLPGLAGKEGTKGDPGPAGLPGKDGPPGLRGFPGDRGLPGPVGALGLKGNEG
PPGPPGPAGSPGERGPAGAAGPIGIPGRPGPQGPPGPAGEKGAPGEKGPQGPAGRDGLQGPVGLPGPAGPVGPPGED
GDKGEIGEPGQKGSKGDKGEQGPPGPTGPQGPIGQPGPSGADGEPGPRGQQGLFGQKGDEGPRGFPGPPGPVGLQGL
PGPPGEKGETGDVGQMGPPGPPGPRGPSGAPGADGPQGPPGGIGNPGAVGEKGEPGEAGEPGPSGRSGPPGPKGERG
EKGESGPSGAAGPPGPKGPPGDDGPKGSPGPVGFPGDPGPPGEPGPAGQDGPPGDKGDDGEPGQTGSPGPTGEPGPS
GPPGKRGPPGPAGPEGRQGEKGAKGEAGLEGPPGKTGPIGPQGAPGKPGPDGLRGIPGPVGEQGLPGSPGPDGPPGP
MGPPGLPGLKGDSGPKGEKGHPGLIGLIGPPGEQGEKGDRGLPGPQGSSGPKGEQGITGPSGPIGPPGPPGLPGPPG
PKGAKGSSGPTGPRGEAGHPGPPGPPGPPGEVIQPLPIQASRTRRNIDASQLLDDGNGENYVDYADGMEEIFGSLNS
LKLEIEQMKRPLGTQQNPARTCKDLQLCHPDFPDGEYWVDPNQGCSRDSFKVYCNFTAGGSTCVFPDKKSEGARITS
WPKENPGSWFSEFKRGKLLSYVDAEGNPVGVVQMTFLRLLSASAHQNVTYHCYQSVAWQDAATGSYDKALRFLGSND
EEMSYDNNPYIRALVDGCATKKGYQKTVLEIDTPKVEQVPIVDIMFNDFGEASQKFGFEVGPACFMG

Signal sequence.
amino acids 1-36
N-glycosylation sites.
amino acids 159-162, 176-180, 385-388, 1672-1675, 1741-1744
cAMP- and cGMP-dependent protein kinase phosphorylation sites.
amino acids 65-68, 109-112, 184-187, 185-188
Tyrosine kinase phosphorylation sites.
amino acids 69-75, 410-416, 410-417, 410-417
N-myristoylation sites.
amino acids 54-59, 129-134, 157-162, 433-438, 446-451, 505-510, 528-533, 529-534, 579-584, 613-618, 724-729, 754-759, 793-798, 802-807, 849-854, 934-939, 1072-1077, 1165-1170, 1261-1266, 1276-1281, 1543-1548, 1596-1601, 1613-1618, 1676-1681, 1689-1694, 1701-1706, 1720-1725
Amidation sites.
amino acids 606-609, 1389-1392
Prenyl group binding site (CAAX box).
amino acids 1835-1839
Cell attachment sequences.
amino acids 645-647, 663-665
Collagen triple helix repeats.
amino acids 469-528, 554-612, 613-672, 673-732, 733-792, 793-852, 853-912, 913-972, 973-1032, 1033-1092, 1096-1155, 1156-1215, 1216-1275, 1276-1335, 1336-1395, 1396-1455, 1456-1515, 1516-1575
Fibrillar collagen C-terminal domain.
amino acids 1625-1836
Thrombospondin N-terminal-like domain.
amino acids 39-230

FIGURE 163

MADSERLSAPGCWAACTNFSRTRKGILLFAEIILCLVILICFSASTPGYSSLSVIEMILAAIFFVVYMCDLHTKIPF
INWPWSDFFRTLIAAILYLITSIVVLVERGNHSKIVAGVLGLIATCLFGYDAYVTFPVRQPRHTAAPTDPADGPV

Transmembrane domains.
amino acids 23-43, 51-71, 81-101, 111-131

N-glycosylation sites.
amino acids 18-21, 108-113

N-myristoylation sites.
amino acids 11-16, 118-123

FIGURE 164

MAPRTLWSCYLCCLLTAAAGAASYPPRGFSLYTGSSGALSPGGPQAQIAPRPASRHRNWCAYVVTRTVSCVLEDGVE
TYVKYQPCAWGQPQCPQSIMYRRFLRPRYRVAYKTVTDMEWRCCQGYGGDDCAESPAPALGPASSTPRPLARPARPN
LSGSSAGSPLSGLGGEGPGESEKVQQLEEQVQSLTKELQGLRGVLQGLSGRLAEDVQRAVETAFNGRQQPADAAARP
GVHETLNEIQHQLQLLDTRVSTHDQELGHLNNHHGGSSSSGGSRAPAPASAPPGPSEELLRQLEQRLQESCSVCLAG
LDGFRRQQQEDRERLRAMEKLLASVEERQRHLAGLAVGRRPPQECCSPELGRRLAELERRLDVVAGSVTVLSGRRGT
ELGGAAGQGGHPPGYTSLASRLSRLEDRFNSTLGPSEEQEESWPGAPGGLSHWLPAARGRLEQLGGLLANVSGELGG
RLDLLEEQVAGAMQACGQLCSGAPGEQDSQVSEILSALERRVLDSEGQLRLVGSGLHTVEAAGEARQATLEGLQEVV
GRLQDRVDAQDETAAEFTLRLNLTAARLGQLEGLLQAHGDEGCGACGGVQEELGRLRDGVERCSCPLLPPRGPGAGP
GVGGPSRGPLDGFSVFGGSSGSALQALQGELSEVILSFSSLNDSLNELQTTVEGQGADLADLGATKDRIISEINRLQ
QEATEHATESEERFRGLEEGQAQAGQCPSLEGRLGRLEGVCERLDTVAGGLQGLREGLSRHVAGLWAGLRETNTTSQ
MQAALLEKLVGGQAGLGRRLGALNSSLQLLEDRLHQLSLKDLTGPAGEAGPPGPPGLQGPPGPAGPPGSPGKDGQEG
PIGPPGPQGEQGVEGAPAAPVPQVAFSAALSLPRSEPGTVPFDRVLLNDGGYYDPETGVFTAPLAGRYLLSAVLTGH
RHEKVEAVLSRSNQGVARVDSGGYEPEGLENKPVAESQPSPGTLGVFSLILPLQAGDTVCVDLVMGQLAHSEEPLTI
FSGALLYGDPELEHA

Signal sequence.
amino acids 1-23
N-glycosylation sites.
amino acids 154-157, 415-418, 455-458, 561-564, 658-661, 766-769, 794-794
Glycosaminoglycan attachment site.
amino acids 165-168
cAMP- and cGMP-dependent protein kinase phosphorylation site.
amino acids 382-385
N-myristoylation sites.
amino acids 34-39, 42-47, 125-130, 157-162, 161-166, 197-202, 232-237, 266-271, 267-272, 342-347, 384-389, 388-393, 430-435, 450-455, 451-456, 473-478, 479-484, 568-573, 572-577, 581-586, 583-588, 598-603, 613-618, 633-638, 634-639, 672-677, 709-714, 713-718, 718-723, 742-747, 746-751, 757-762, 761-766, 781-786, 791-796
Amidation sites.
amino acids 345-348, 358-361, 380-383, 786-789
Leucine zipper pattern.
amino acids 181-202, 439-460, 446-467, 723-744, 730-751, 737-758, 779-800, 786-807, 992-813
Collagen triple helix repeat (20 copies).
amino acids 809-867
C1q domain.
amino acids 872-1007

FIGURE 165

MEGSRPRSSLSLASSASTISSLSSLSPKKPTRAVNKIHAFGKRGNALRRDPNLPVHIRGWLHKQDSSGLRLWKRRWF
VLSGHCLFYYKDSREESVLGSVLLPSYNIRPDGPGAPRGRRFTFTAEHPGMRTYVLAADTLEDLRGWLRALGRASRA
EGDDYGQPRSPARPQPGEGPGGPGGPPEVSRGEEGRISESPEVTRLSRGRGRPRLLTPSPTTDLHSGLQMRRARSPD
LFTPLSRPPSPLSLPRPRSAPARRPPAPSGDTAPPARPHTPLSRIDVRPPLDWGPQRQTLSRPPTPRRGPPSEAGGG
KPPRSPQHWSQEPRTQAHSGSPTYLQLPPRPPGTRASMVLLPGPPLESTFHQSLETDTLLTKLCGQDRLLRRLQEEI
DQKQEEKEQLEAALELTRQQLGQATREAGAPGRAWGRQRLLQDRLVSVRATLCHLTQERERVWDTYSGLEQELGTLR
ETLEYLLHLGSPQDRVSAQQQLWMVEDTLAGLGGPQKPPPHTEPDSPSPVLQGEESSERESLPESLELSSPRSPETD
WGRPPGGDKDLASPHLGLGSPRVSRASSPEGRHLPSPQLGTKAPVARPRMNAQEQLERMRRNQECGRPFPRPTSPRL
LTLGRTLSPARRQPDVEQRPVVGHSGAQKWLRSSGSWSSPRNTTPYLPTSEGHRERVLSLSQALATEASQWHRMMTG
GNLDSQGDPLPGVPLPPSDPTRQETPPPRSPPVANSGSTGFSRRGSGRGGGPTPWGPAWDAGIAPPVLPQDEGAWPL
RVTLLQSSL

Signal sequence.
amino acids 1-21

Glycosaminoglycan attachment site.
amino acids 739-742 cAMP- and cGMP-dependent protein kinase phosphorylation sites.
amino acids 28-31, 117-120, 736-739

N-myristoylation sites.
amino acids 112-117, 341-346, 694-399, 738-743

Amidation sites.
amino acids 40-43, 115-118

PH domain.
amino acids 55-153

FIGURE 166

MSSKRAKAKATKKRPQRATSNVFAMFDQSQIQEFKEAFNMIDQNRDGFIDKEDLHDMLASLGKNPTDEYLEGMMSEA
PGPYNFTMFLTMFGEKLNGTDPEDVIRNAFACFDEESSGFIHEDHLRKLLTTMGDRFTDEEVDEMYREAPVDKKGNF
NYVEFTRILKHGAKDKHD

N-glycosylation sites.
amino acids 82-85, 95-98

EF hand.
amino acids 33-61

FIGURE 167

MANKGPSYGMSREVQSKIEKKYDEELEERLVEWIIVQCGPDVGRPDRGPLGFQVWLKNGVILSKLVNSLYPDGSKPV
KVPENPPSMVFKQMEQVAQFLKAAEDSGVIKTDMFQTVDLFEGKDMAAVQRTLMALGSLAVTKNDGHYRGDPNWFMK
KAQEHKREFTESQLQEGKHVIGLQMGSNRGASQAGMTGYGRPRQIIS

N-myristoylation sites.
amino acids 59-64, 105-109, 176-181, 180-185, 184-189

Cell attachment sequence.
amino acids 146-148

Calponin family repeat.
amino acids 175-194

Calponin homology (CH).
amino acids 25-138

Calponin family repeat.
amino acids 175-200

FIGURE 168

MACPLEKALDVMVSTFHKYSGKEGDKFKLNKSELKELLTRELPSFLGKRTDEAAFQKLMSNLDSNRDNEVDFQEYCV
FLSCIAMMCNEFFEGFPDKQPRKK

N-glycosylation site.
amino acids 30-33

Amidation site.
amino acids 46-49

S-100/ICaBP type calcium binding domain.
amino acids 5-48

FIGURE 169

MDEGPVDLRTRPKAAGLPGAALPLRKRPLRAPSPEPAAPRGAAGLVVPLDPLRGGCDLPAVPGPPHGLARPEALYYP
GALLPLYPTRAMGSPFPLVNLPTPLYPMMCPMEHPLSADIAMATRADEDGDTPLHIAVVQGNLPAVHRLVNLFQQGG
RELDIYNNLRQTPLHLAVITTLPSVVRLLVTAGASPMALDRHGQTAAHLACEHRSPTCLRALLDSAAPGTLDLEARN
YDGLTALHVAVNTECQETVQLLLERGADIDAVDIKSGRSPLIHAVENNSLSMVQLLLQHGANVNAQMYSGSSALHSA
SGRGLLPLVRTLVRSGADSSLKNCHNDTPLMVARSRRVIDILRGKATRPASTSQPDPSPDRSANTSPESSSRLSSNG
LLSASPSSSPSQSPPRDPPGFPMAPPNFFLPSPSPPAFLPFAGVLRGPGRPVPPSPAPGGS

Transmembrane domain.
amino acids 170-190

N-glycosylation site.
amino acids 278-231

Glycosaminoglycan attachment site.
amino acids 309-312

N-myristoylation sites.
amino acids 16-21, 138-143, 197-202, 291-296, 324-329, 385-390

Ankyrin repeats.
amino acids 126-162, 163-195, 196-227, 233-265, 267-299

FIGURE 170

MYQDYPGNFDTSSRGSSGSPAHAESYSSGGGGQQKFRVDMPGSGSAFIPTINAITTSQDLQWMVQPTVITSMSNPYP
RSHPYSPLPGLASVPGHMALPRPGVIKTIGTTVGRRRRDEQLSPEEEEKRRIRRERNKLAAAKCRNRRRELTEKLQA
ETEELEEEKSGLQKEIAELQKEKEKLEFMLVAHGPVCKISPEERRSPPAPGLQPMRSGGGSVGAVVVKQEPLEEDSP
SSSSAGLDKAQRSVIKPISIAGGFYGEEPLHTPIVVTSTPAVTPGTSNLVFTYPSVLEQESPASPSESCSKAHRRSS
SSGDQSSDSLNSPTLLAL

Glycosaminoglycan attachment sites.
amino acids 28-31, 211-214 cAMP- and cGMP-dependent protein kinase phosphorylation site.
amino acids 305-308

N-myristoylation sites.
amino acids 7-13, 42-47, 101-106, 107-122, 213-218, 214-219, 237-242, 253-258

Amidation site.
amino acids 110-113

Leucine zipper patterns.
amino acids 152-173, 159-180 bZIP transcription factors basic domain signature.
amino acids 130-144, 131-144 bZIP transcription factor homology.
amino acids 122-186

FIGURE 171

MESGFTSKDTYLSHFNPRDYLEKYYKFGSRHSAESQILKHLLKNLFKIFCLDGVKGDLLIDIGSGPTIYQLLSACES
FKEIVVTDYSDQNLQELEKWLKKEPEAFDWSPVVTYVCDLEGNRVKGPEKEEKLRQAVKQVLKCDVTQSQPLGAVPL
PPADCVLSTLCLDAACPDLPTYCRALRNLGSLLKPGGFLVIMDALKSSYYMIGEQKFSSLPLGREAVEAAVKEAGYT
IEWFEVISQSYSSTMANNEGLFSLVARKLSRPL cAMP- and cGMP-dependent protein kinase phosphorylation site.
amino acids 258-261

Tyrosine kinase phosphorylation site.
amino acids 18-25

N-myristoylation sites.
amino acids 28-33, 63-68

Leucine zipper pattern.
amino acids 166-187

NNMT/PNMT/TEMT family of methyltransferases signature.
amino acids 59-75

NNMT/PNMT/TEMT family homology.
amino acids 1-259

FIGURE 172

MANRGPAYGLSREVQQKIEKQYDADLEQILIQWITTQCRKDVGRPQPGRENFQNWLKDGTVLCELINALYPEGQAPV
KKIQASTMAFKQMEQISQFLQAAERYGINTTDIFQTVDLWEGKNMACVQRTLMNLGGLAVARDDGLFSGDPNWFPKK
SKENPRNFSDNQLQEGKNVIGLQMGTNRGASQAGMTGYGMPRQIL

N-glycosylation sites.
amino acids 106-109, 161-164

N-myristoylation sites.
amino acids 59-64, 104-109, 134-139, 142-147, 175-180, 179-184, 183-188

Calponin family repeat.
amino acids 174-193

Calponin homology (CH) domain.
amino acids 25-137

Calponin family repeat.
amino acids 174-199

FIGURE 173

MPKTISVRVTTMDAELEFAIQPNTTGKQLFDQVVKTIGLREVWFFGLQYQDTKGFSTWLKLNKKVTAQDVRKESPLL
FKFRAKFYPEDVSEELIQDITQRLFFLQVKEGILNDDIYCPPETAVLLASYAVQSKYGDFNKEVHKSGYLAGDKLLP
QRVLEQHKLNKDQWEERIQVWHEEHRGMLREDAVLEYLKIAQDLEMYGVNYFSIKNKKGSELWLGVDALGLNIYEQN
DRLTPKIGFPWSEIRNISFNDKKFVIKPIDKKAPDFVFYAPRLRINKRILALCMGNHELYMRRRKPDTIEVQQMKAQ
AREEKHQKQMERAMLENEKKKREMAEKEKEKIEREKEELMERLKQIEEQTKKAQQELEEQTRRALELEQERKRAQSE
AEKLAKERQEAEEAKEALLQASRDQKKTQEQLALEMAELTARISQLEMARQKKESEAVEWQQKAQMVQEDLEKTRAE
LKTAMSTPHVAEPAENEQDEQDENGAEASADLRADAMAKDRSEEERTTEAEKNERVQKHLKALTSELANARDESKKT
ANDMIHAENMRLGRDKYKTLRQIRQGNTKQRIDEFESM

N-glycosylation sites.
amino acids 23-28, 247-250 cAMP- and cGMP-dependent protein kinase phosphorylation sites.
amino acids 63-66, 71-74, 211-214, 437-440

Tyrosine kinase phosphorylation sites.
amino acids 193-201, 262-270, 263-270

N-myristoylation site.
amino acids 487-492

Ezrin/radixin/moesin family homology.
amino acids 208-577

FERM domain (Band 4.1 family) homology.
amino acids 7-206

FIGURE 174

MAMVSEFLKQAWFIENEEQEYVQTVKSSKGGPGSAVSPYPTFNPSSDVAALHKAIMVKGVDEATIIDILTKRNNAQR
QQIKAAYLQETGKPLDETLKKALTGHLEEVVLALLKTPAQFDADELRAAMKGLGTDEDTLIEILASRTNKEIRDINR
VYREELKRDLAKDITSDTSGDFRNALLSLAKGDRSEDFGVNEDLADSDARALYEAGERRKGTDVNVFNTILTTRSYP
QLRRVFQKYTKYSKHDMNKVLDLELKGDIEKCLTAIVKCATSKPAFFAEKLHQAMKGVGTRHKALIRIMVSRSEIDM
NDIKAFYQKMYGISLCQAILDETKGDYEKILVALCGGN cAMP- and cGMP-dependent protein kinase phosphorylation site.
amino acids 213-216

N-myristoylation sites.
amino acids 30-35, 59-64, 215-220, 320-325

Annexin homology.
amino acids 44-111, 116-183, 199-267, 275-342

FIGURE 175

MSTVHEILCKLSLEGDHSTPPSAYGSVKAYTNFDAERDALNIETAIKTKGVDEVTIVNILTNRSNAQRQDIAFAYQR
RTKKELASALKSALSGHLETVILGLLKTPAQYDASELKASMKGLGTDEDSLIEIICSRTNQELQEINRVYKEMYKTD
LEKDIISDTSGDFRKLMVALAKGRRAEDGSVIDYELIDQDARDLYDAGVKRKGTDVPKWISIMTERSVPHLQKVFDR
YKSYSPYDMLESIRKEVKGDLENAFLNLVQCIQNKPLYFADRLYDSMKGKGTRDKVLIRIMVSRSEVDMLKIRSEFK
RKYGKSLYYYIQQDTKGDYQKALLYLCGGDD

N-glycosylation site.
amino acids 62-65 cAMP- and cGMP-dependent protein kinase phosphorylation site.
amino acids 205-208

N-myristoylation site.
amino acids 25-30

Amidation site.
amino acids 176-179

Annexin homology.
amino acids 35-102, 107-174, 191-259, 267-334

FIGURE 176

MYVTMMMTDQIPLELPPLLNGEVAMMPHLVNGDAAQHVILVQVNPGETFTIRAEDGTLQCIQGPAEVPMMSPNGSIP
PIHVPPGYISQVIEDSTGVRRVVVTPQSPECYPPSYPSAMSPTHHLPPYLTHHPHFIHNSHTAYYPPVTGPGDMPPQ
FFPQHHLPHTIYGEQEIIPFYGMSSYITREDQYSKPPHKKLKDRQIDRQNRLNSPPSSIYKSSCTTVYNGYGKGHSG
GSGGGGSGSGPGIKKTERRARSSPKSNDSDLQEYELEVKRVQDILSGIEKPQVSNIQARAVVLSWAPPVGLSCGPHS
GLSFPYSYEVALSDKGRDGKYKIIYSGEELECNLKDLRPATDYHVRVYAMYNSVKGSCSEPVSFTTHSCAPECPFPP
KLAHRSKSSLTLQWKAPIDNGSKITNYLLEWDEGKRNSGFRQCFFGSQKHCKLTKLCPAMGYTFRLAARNDIGTSGY
SQEVVCYTLGNIPQMPSALRLVRAGITWVTLQWSKPEGCSPEEVITYTLEIQEDENDNLFHPKYTGEDLTCTVKNLK
RSTQYKFRLTASNTEGKSCPSEVLVCTTSPDRPGPPTRPLVKGPVTSHGFSVKWDPPKDNGGSEILKYLLEITDGNS
EANQWEVAYSGSATEYTFTHLKPGTLYKLRACCISTGGHSQCSESLPVRTLSIAPGQCRPPRVLGRPKHKEVHLEWD
VPASESGCEVSEYSVEMTEPEDVASEVYHGPELECTVGNLLPGTVYRFRVRALNDGGYGPYSDVSEITTAAGPPGQC
KAPCISCTPDGCVLVGWESPDSSGADISEYRLEWGEDEESLELIYHGTDTRFEIRDLLPAAQYCCRLQAFNQAGAGP
YSELVLCQTPASAPDPVSTLCVLEEEPLDAYPDSPSACLVLNWEEPCNNGSEILAYTIDLGDTSITVGNTTMHVMKD
LLPETTYRIRIQAINEIGAGPFSQFIKAKTRPLPPLPPRLECAAAGPQSLKLKWGDSNSKTHAAEDIVYTLQLEDRN
KRFISIYRGPSHTYKVQRLTEFTCYSFRIQAASEAGEGPFSETYTFSTTKSVPPTIKAPRVTQLEVNSCEILWETVP
SMKGDPVNYILQVLVGRESEYKQVYKGEEATFQISGLQTNTDYRFRVCACRRCLDTSQELSGAFSPSAAFVLQRSEV
MLTGDMGSLDDPKMKSMMPTDEQFAAIIVLGFATLSILFAFILQYFLMK

Transmembrane domain.

amino acids 1180-1200

Signal sequence.

amino acids 1-32

N-glycosylation sites.

amino acids 73-76, 258-261, 405-408, 896-899, 916-919

Glycosaminoglycan attachment sites.

amino acids 233-236, 238-241, 240-243 cAMP- and cGMP-dependent protein kinase phosphorylation sites.

amino acids 420-423, 539-542

Tyrosine kinase phosphorylation sites.

amino acids 323-329, 744-751, 1019-1026

N-myristoylation sites.

amino acids 56-61, 231-236, 232-237, 234-238, 235-240, 236-241, 239-244, 243-248, 406-411, 614-619, 700-705, 794-799, 1114-1119

Amidation site.

amino acids 418-421

ATP/GTP-binding site motif A (P-loop).

amino acids 550-557

Fibronectin type III domains.

amino acids 276-364, 379-463, 475-560, 572-659, 671-755, 767-849, 861-947, 958-1042, 1054-1135

FIGURE 177

MRIPVDASTSRRFTPPSTALSPGKMSEALPLGAPDAGAALAGKLRSGDRSMVEVLADHPGELVRTDSPNFLCSVLPT
HWRCNKTLPIAFKVVALGDVPDGTLVTVMAGNDENYSAELRNATAAMKNQVARFNDLRFVGRSGRGKSFTLTITVFT
NPPQVATYHRAIKITVDGPREPRRHRQKLDDQTKPGSLSFSERLSELEQLRRTAMRVSPHHPAPTPNPRASLNHSTA
FNPQPQSQMQDTRQIQPSPPWSYDQSYQYLGSIASPSVHPATPISPGRASGMTTLSAELSSRLSTAPDLTAFSDPRQ
FPALPSISDPRMHYPGAFTYSPTPVTSGIGIGMSAMGSATRYHTYLPPPYPGSSQAQGGPFQASSPSYHLYYGASAG
SYQFSMVGGERSPPRILPPCTNASTGSALLNPSLPNQSDVVEAEGRHRNSPTNMGGASCSRQARRDPGPWARTPSWG
RGRPTDRISL

N-glycosylation sites.
amino acids 82-85, 112-115, 119-122, 227-230, 407-410, 421-424

Glycosaminoglycan attachment sites.
amino acids 140-143, 335-338 cAMP- and cGMP-dependent protein kinase phosphorylation site.
amino acids 11-14

N-myristoylation sites.
amino acids 32-37, 37-42, 100-105, 108-113, 336-341, 338-343, 360-365, 381-386, 440-445, 441-446

ATP/GTP-binding site motif A (P-loop).
amino acids 138-145

Runt domain.
amino acids 48-182

FIGURE 178

MASEIHMTGPMCLIENTNGRLMANPEALKILSAITQPMVVVAIVGLYRTGKSYLMNKLAGKKKGFSLGSTVQSHTKG
IWMWCVPHPKKPGHILVLLDTEGLGDVEKGDNQNDSWIFALAVLLSSTFVYNSIGTINQQAMDQLYYVTELTHRIRS
KSSPDENENEVEDSADFVSFFPDFVWTLRDFSLDLEADGQPLTPDEYLTYSLKLKKGTSQKDETFNLPRLCIRKFFP
KKKCFVFDRPVHRRKLAQLEKLQDEELDPEFVQQVADFCSYIFSNSKTKTLSGGIQVNGPRLESLVLTYVNAISSGD
LPCMENAVLALAQIENSAAVQKAIAHYEQQMGQKVQLPTESLQELLDLHRDSEREAIEVFIRSSFKDVDHLFQKELA
AQLEKKRDDFCKQNQEASSDRCSGLLQVIFSPLEEEVKAGIYSKPGGYRLFVQKLQDLKKKYYEEPRKGIQAEEILQ
TYLKSKESMTDAILQTDQTLTEKEKEIEVERVKAESAQASAKMLQEMQRKNEQMMEQKERSYQEHLKQLTEKMENDR
VQLLKEQERTLALKLQEQEQLLKEGFQKESRIMKNEIQDLQTKMRRRKACTIS

Transmembrane domains.
amino acids 24-44, 113-133

N-glycosylation site.
amino acids 111-114 cAMP- and cGMP-dependent protein kinase phosphorylation site.
amino acids 209-212

N-myristoylation sites.
amino acids 45-50, 285-290

Amidation site.
amino acids 59-62

Prenyl group binding site (CAAX box).
amino acids 589-593

ATP/GTP-binding site motif A (P-loop).
amino acids 45-52

Guanylate-binding protein, N-terminal homology.
amino acids 6-282

Guanylate-binding protein, C-terminal homology.
amino acids 284-580

FIGURE 179

MRVTLATIAWMVSFVSNYSHTANILPDIENEDFIKDCVRIHNKFRSEVKPTASDMLYMTWDPALAQIAKAWASNCQF
SHNTRLKPPHKLHPNFTSLGENIWTGSVPIFSVSSAITNWYDEIQDYDFKTRICKKVCGHYTQVVWADSYKVGCAVQ
FCPKVSGFDALSNGAHFICNYGPGGNYPTWPYKRGATCSACPNNDKCLDNLCVNRQRDQVKRYYSVVYPGWPIYPRN
RYTSLFLIVNSVILILSVIITILVQLKYPNLVLLD

Transmembrane domain.
amino acids 236-256

N-glycosylation sites.
amino acids 17-20, 92-95

N-myristoylation sites.
amino acids 179-184, 189-194

Extracellular proteins SCP/Tpx-1/Ag5/PR-1/Sc7 signature 1.
amino acids 136-146

SCP-like extracellular protein.
amino acids 38-174

FIGURE 180

MNFAEREGSKRYCIQTKHVAILCAVVVGVGLIVGLAVGLTRSCDSSGDGGPGTAPAPSHLPSSTASPSGPPAQDQDI
CPASEDESGQWKNFRLPDFVNPVHYDLHVKPLLEEDTYTGTVSISINLSAPTRYLWLHLRETRITRLPELKRPSGDQ
VQVRRCFEYKKQEYVVVEAEEELTPSSGDGLYLLTMEFAGWLNGSLVGFYRTTYTENGRVKSIAATDHEPTDARKSF
PCFDEPNKKATYTISITHPKEYGALSNMPVAKEESVDDKWTRTTFEKSVPMSTYLVCFAVHQFDSVKRISNSGKPLT
IYVQPEQKHTAEYAANITKSVFDYFEEYFAMNYSLPKLDKIAIPDFGTGAMENWGLITYRETNLLYDPKESASSNQQ
RVATVVAHELVHQWFGNIVTMDWWEDLWLNEGFASFFEFLGVNHAETDWQMRDQMLLEDVLPVQEDDSLMSSHPIIV
TVTTPDEITSVFDGISYSKGSSILRMLEDWIKPENFQKGCQMYLEKYQFKNAKTSDFWAALEEASRLPVKEVMDTWT
RQMGYPVLNVNGVKNITQKRFLLDPRANPSQPPSDLGYTWNIPVKWTEDNITSSVLFNRSEKEGITLNSSNPSGNAF
LKINPDHIGFYRVNYEVATWDSIATALSLNHKTFSSADRASLIDDAFALARAQLLDYKVALNLTKYLKREENFLPWQ
RVISAVTYIISMFEDDKELYPMIEEYFQGQVKPIADSLGWNDAGDHVTKLLRSSVLGFACKMGDREALNNASSLFEQ
WLNGTVSLPVNLRLLVYRYGMQNSGNEISWNYTLEQYQKTSLAQEKEKLLYGLASVKNVTLLSRYLDLLKDTNLIKT
QDVFTVIRYISYNSYGKNMAWNWIQLNWDYLVNRYTLNNRNLGRIVTIAEPFNTELQLWQMESFFAKYPQAGAGEKP
REQVLETVKNNIEWLKQHRNTIREWFFNLLESG

Signal sequence.
amino acids 1-42

N-glycosylation sites.
amino acids 124-127, 197-200, 324-327, 340-343, 554-557, 589-592, 597-600, 607-610, 678-681, 763-766, 773-776, 801-804, 828-831

Glycosaminoglycan attachment sites.
amino acids 46-49, 181-184 cAMP- and cGMP-dependent protein kinase phosphorylation sites.
amino acids 148-151, 239-242, 298-301

Tyrosine kinase phosphorylation site.
amino acids 107-115

N-myristoylation sites.
amino acids 30-35, 34-39, 38-43, 49-54, 86-90, 198-203, 254-259, 357-362, 401-406, 426-431, 476-481, 603-608, 790-795, 795-800

Neutral zinc metallopeptidases, zinc-binding region signature.
amino acids 390-399

Peptidase family M homology.
amino acids 193-482

FIGURE 181

MAKISSPTETERCIESLIAVFQKYAGKDGYNYTLSKTEFLSFMNTELAAFTKNQKDPGVLDRMMKKLDTNSDGQLDF
SEFLNLIGGLAMACHDSFLKAVPSQKRT

N-glycosylation site.
amino acids 31-34

S-100/ICaBP type calcium binding domain.
amino acids 10-53

EF hand.
amino acids 59-87

FIGURE 182A

MSSSHSRAGQSAAGAAPGGGVDTRDAEMPATEKDLAEDAPWKKIQQNTFTRWCNEHLKCVSKRIANLQTDLSDGLRL
IALLEVLSQKKMHRKHNQRPTFRQMQLENVSVALEFLDRESIKLVSIDSKAIVDGNLKLILGLIWTLILHYSISMPM
WDEEEDEEAKKQTPKQRLLGWIQNKLPQLPITNFSRDWQSGRALGALVDSCAPGLCPDWDSWDASKPVTNAREAMQQ
ADDWLGIPQVITPEEIVDPNVDEHSVMTYLSQFPKAKLKPGAPLRPKLNPKKARAYGPGIEPTGNMVKKRAEFTVET
RSAGQGEVLVYVEDPAGHQEEAKVTANNDKNRTFSVWYVPEVTGTHKVTVLFAGQHIAKSPFEVYVDKSQGDASKVT
AQGPGLEPSGNIANKTTYFEIFTAGAGTGEVEVVIQDPMGQKGTVEPQLEARGDSTYRCSYQPTMEGVHTVHVTFAG
VPIPRSPYTVTVGQACNPSACRAVGRGLQPKGVRVKETADFKVYTKGAGSGELKVTVKGPKGEERVKQKDLGDGVYG
FEYYPMVPGTYIVTITWGGQNIGRSPFEVKVGTECGNQKVRAWGPGLEGGVVGKSADFVVEAIGDDVGTLGFSVEGP
SQAKIECDDKGDGSCDVRYWPQEAGEYAVHVLCNSEDIRLSPFMADIRDAPQDFHPDRVKARGPGLEKTGVAVNKPA
EFTVDAKHGGKAPLRVQVQDNEGCPVEALVKDNGNGTYSCSYVPRKPVKHTAMVSWGGVSIPNSPFRVNVGAGSHPN
KVKVYGPGVAKTGLKAHEPTYFTVDCAEAGQGDVSIGIKCAPGVVGPAEADIDFDIIRNDNDTFTVKYTPRGAGSYT
IMVLFADQATPTSPIRVKVEPSHDASKVKAEGPGLSRTGVELGKPTHFTVNAKAAGKGKLDVQFSGLTKGDAVRDVD
IIDHHDNTYTVKYTPVQQGPVGVNVTYGGDPIPKSPFSVAVSPSLDLSKIKVSGLGEKVDVGKDQEFTVKSKGAGGQ
GKVASKIVGPSGAAVPCKVEPGLGADNSVVRFLPREEGPYEVEVTYDGVPVPGSPFPLEAVAPTKPSKVKAFGPGLQ
GGSAGSPARFTIDTKGAGTGGLGLTVEGPCEAQLECLDNGDGTCSVSYVPTEPGDYNINILFADTHIPGSPFKAHVV
PCFDASKVKCSGPGLERATAGEVGQFQVDCSSAGSAELTIEICSEAGLPAEVYIQDHGDGTHTITYIPLCPGAYTVT
IKYGGQPVPNFPSKLQVEPAVDTSGVQCYGPGIEGQGVFREATTEFSVDARALTQTGGPHVKARVANPSGNLTETYV
QDRGDGMYKVEYTPYEEGLHSVDVTYDGSPVPSSPFQVPVTEGCDPSRVRVHGPGIQSGTTNKPNKFTVETRGAGTG
GLGLAVEGPSEAKMSCMDNKDGSCSVEYIPYEAGTYSLNVTYGGHQVPGSPFKVPVHDVTDASKVKCSGPGLSPGMV
RANLPQSFQVDTSKAGVAPLQVKVQGPKGLVEPVDVVDNADGTQTVNYVPSREGPYSISVLYGDEEVPRSPFKVKVL
PTHDASKVKASGPGLNTTGVPASLPVEFTIDAKDAGEGLLAVQITDPEGKPKKTHIQDNHDGTYTVAYVPDVTGRYT
ILIKYGGDEIPFSPYRVRAVPTGDASKCTVTVSIGGHGLGAGIGPTIQIGEETVITVDTKAAGKGKVTCTVCTPDGS
EVDVDVVENEDGTFDIFYTAPQPGKYVICVRFGGEHVPNSPFQVTALAGDQPSVQPPLRSQQLAPQYTYAQGGQQTW
APERPLVGVNGLDVTSLRPFDLVIPFTIKKGEITGEVRMPSGKVAQPTITDNKDGTVTVRYAPSEAGLHEMDIRYDN
MHIPGSPLQFYVDYVNCGHVTAYGPGLTHGVVNKPATFTVNTKDAGEGGLSLAIEGPSKAEISCTDNQDGTCSVSYL
PVLPGDYSILVKYNEQHVPGSPFTARVTGDDSMRMSHLKVGSAADIPINISETDLSLLTATVVPPSGREEPCLLKRL
RNGHVGISFVPKETGEHLVHVKKNGQHVASSPIPVVISQSEIGDASRVRVSGQGLHEGHTFEPAEFIIDTRDAGYGG
LSLSIEGPSKVDINTEDLEDGTCRVTYCPTEPGNYIINIKFADQHVPGSPFSVKVTGEGRVKESITRRRRAPSVANV
GSHCDLSLKIPEISIQDMTAQVTSPSGKTHEAEIVEGENHTYCIRFVPAEMGTHTVSVKYKGQHVPGSPFQFTVGPL
GEGGAHKVRAGGPGLERAEAGVPAEFSIWTREAGAGGLAIAVEGPSKAEISFEDRKDGSCGVAYVVQEPGDYEVSVK
FNEEHIPDSPFVVPVASPSGDARRLTVSSLQESGLKVNQPASFAVSLNGAKGAIDAKVHSPSGALEECYVTEIDQDK
YAVRFIPRENGVYLIDVKFNGTHIPGSPFKIRVGEPGHGGDPGLVSAYGAGLEGGVTGNPAEFVVNTSNAGAGALSV
TIDGPSKVKMDCQECPEGYRVTYTPMAPGSYLISIKYGGPYHIGGSPFKAKVTGPRLVSNHSLHETSSVFVDSLTKA
TCAPQHGAPGPGPADASKVVAKGLGLSKAYVGQKSSFTVDCSKAGNNMLLVGVHGPRTPCEEILVKHVGSRLYSVSY
LLKDKGEYTLVVKWGHEHIPGSPYRVVVP

Transmembrane domain.
amino acids 131-151

FIGURE 182B

N-glycosylation sites.
amino acids 106-109, 187-190, 339-342, 399-402, 728-731, 831-834, 948-951, 1303-1306, 1425-1428, 1556-1559, 1974-1977, 2195-2198, 2407-2410, 2453-2458, 2524-2527

Glycosaminoglycan attachment sites.
amino acids 977-980, 1166-1169, 1454-1457, 1551-1554, 2053-2056 cAMP- and cGMP-dependent protein kinase phosphorylation sites.
amino acids 164-167, 2333-2336

Tyrosine kinase phosphorylation sites.
amino acids 498-406, 531-539, 785-791

N-myristoylation sites.
amino acids 9-14, 14-19, 19-24, 139-144, 290-295, 362-367, 390-395, 395-400, 410-415, 425-430, 509-514, 558-563, 571-576, 585-590, 588-593, 681-686, 686-691, 729-734, 766-771, 778-783, 881-886, 886-891, 913-918, 946-951, 1025-1030, 1076-1081, 1079-1084, 1094-1099, 1099-1104, 1169-1174, 1352-1357, 1364-1369, 1382-1387, 1387-1392, 1457-1462, 1461-1466, 1554-1559, 1559-1564, 1655-1660, 1659-1664, 1766-1771, 1782-1787, 1874-1879, 1897-1902, 1945-1950, 2027-2032, 2056-2061, 2079-2084, 2127-2132, 2247-2252, 2270-2275, 2344-2349, 2359-2364, 2362-2367, 2426-2431, 2430-2435, 2438-2443, 2441-2446, 2564-2569, 2566-2571, 2573-2578

Cell attachment sequences.
amino acids 437-439, 1312-1314

Actinin-type actin-binding domain signature 1.
amino acids 45-54

Filamin/ABP280 repeats.
amino acids 278-371, 378-471, 477-567, 573-660, 669-760, 766-863, 869-962, 968-1058, 1064-1151, 1157-1246, 1252-1346, 1352-1439, 1445-1536, 1542-1633, 1639-1737, 1779-1857, 1862-1949, 1950-2036, 2044-2131, 2132-2227, 2235-2322, 2329-2417, 2426-2513, 2554-2643

Calponin homology (CH) domains.
amino acids 44-149, 167-269

FIGURE 183

MARGAALALLLFGLLGVLVAAPDGGFDLSDALPDNENKKPTAIPKKPSAGDDFDLGDAVVDGENDDPRPPNPPKPMP
NPNPNHPSSSGSFSDADLADGVSGGEGKGGSDGGGSHRKEGEEADAPGVIPGIVGAVVVAVAGAISSFIAYQKKKLC
FKENAEQGEVDMESHRNANAEPAVQRTLLEK

Signal sequence.
amino acids 1-20

Transmembrane domain.
amino acids 123-143 cAMP- and cGMP-dependent protein kinase phosphorylation sites.
amino acids 38-41, 45-48

N-myristoylation sites.
amino acids 4-9, 16-21, 98-103, 106-111, 107-112, 125-130, 129-134, 140-145

FIGURE 184A

MFINIKSILWMCSTLIVTHALHKVKVGKSPPVRGSLSGKVSLPCHFSTMPTLPPSYNTSEFLRIKWSKIEVDKNGKD
LKETTVLVAQNGNIKIGQDYKGRVSVPTHPEAVGDASLTVVKLLASDAGLYRCDVMYGIEDTQDTVSLTVDGVVFHY
RAATSRYTLNFEAAQKACLDVGAVIATPEQLFAAYEDGFEQCDAGWLADQTVRYPIRAPRVGCYGDKMGKAGVRTYG
FRSPQETYDVYCYVDHLDGDVFHLTVPSKFTFEEAAKECENQDARLATVGELQAAWRNGFDQCDYGWLSDASVRHPV
TVARAQCGGGLLGVRTLYRFENQTGFPPPDSRFDAYCFKRRMSDLSVIGHPIDSESKEDEPCSEETDPVHDLMAEIL
PEFPDIIEIDLYHSEENEEEEEECANATDVTTTPSVQYINGKHLVTTVPKDPEAAEARRGQFESVAPSQNFSDSSES
DTHPFVIAKTELSTAVQPNESTETTESLEVTWKPETYPETSEHFSGGEPDVFPTVPFHEEFESGTAKKGAESVTERD
TEVGHQAHEHTEPVSLFPEESSGEIAIDQESQKIAFARATEVTFGEEVEKSTSVTYTPTIVPSSASAYVSEEEAVTL
IGNPWPDDLLSTKESWVEATPRQVVELSGSSSIPITEGSGEAEEDEDTMFTMVTDLSQRNTTDTLITLDTSRIITES
FFEVPATTIYPVSEQPSAKVVPTKFVSETDTSEWISSTTVEEKKRKEEEGTTGTASTFEVYSSTQRSDQLILPFELE
SPNVATSSDSGTRKSFMSLTTPTQSEREMTDSTPVFTETNTLENLGAQTTEHSSIHQPGVQEGLTTLPRSPASVFME
QGSGEAAADPETTTVSSFSLNVEYAIQAEKEVAGTLSPHVETTFSTEPTGLVLSTVMDRVVAENITQTSREIVISER
LGEPNYGAEIRGFSTGFPLEEDFSGDFREYSTVSHPIAKEETVMMEGSGDAAFRDTQTSPSTVPTSVHISHISDSEG
PSSTMVSTSAFPWEEFTSSAEGSGEQLVTVSSSVVPVLPSAVQKFSGTASSIIDEGLGEVGTVNEIDRRSTILPTAE
VEGTKAPVEKEEVKVSGTVSTNFPQTIEPAKLWSRQEVNPVRQEIESETTSEEQIQEEKSFESPQNSPATEQTIFDS
QTFTETELKTTDYSVLTTKKTYSDDKEMKEEDTSLVNMSTPDPDANGLESYTTLPEATEKSHFFLATALVTESIPAE
HVVTDSPIKKEESTKHFPKGMRPTIQESDTELLFSGLGSGEEVLPTLPTESVNFTEVEQINNTLYPHTSQVESTSSD
KIEDFNRMENVAKEVGPLVSQTDIFEGSGSVTSTTLIEILSDTGAEGPTVAPLPFSTDIGHPQNQTVRWAEEIQTSR
PQTITEQDSNKNSSTAEINETTTSSTDFLARAYGFEMAKEFVTSAPKPSDLYYEPSGEGSGEVDIVDSFHTSATTQA
TRQESSTTFVSDGSLEKHPEVPSAKAVTADGFPTVSVMLPLHSEQNKSSPDPTSTLSNTVSYERSTDGSFQDRFREF
EDSTLKPNRKKPTENIIIDLDKEDKDLILTITESTILEILPELTSDKNTIIDIDHTKPVYEDILGMQTDIDTEVPSE
PHDSNDESNDDSTQVQEIYEAAVNLSLTEETFEGSADVLASYTQATHDESMTYEDRSQLDHMGFHFTTGIPAPSTET
ELDVLLPTATSLPIPRKSATVIPEIEGIKAEAKALDDMFESSTLSDGQAIADQSEIIPTLGQFERTQEEYEDKKHAG
PSFQPEFSSGAEEALVDHTPYLSIATTHLMDQSVTEVPDVMEGSNPPYYTDTTLAVSTFAKLSSQTPSSPLTIYSGS
EASGHTEIPQPSALPGIDVGSSVMSPQDSFKEIHVNIEATFKPSSEEYLHITEPPSLSPDTKLEPSEDDGKPELLEE
MEASPTELIAVEGTEILQDFQNKTDGQVSGEAIKMFPTIKTPEAGTVITTADEIELEGATQWPHSTSASATYGVEAG
VVPWLSPQTSERPTLSSSPEINPETQAALIRGQDSTIAASEQQVAARILDSNDQATVNPVEFNTEVATPPFSLLETS
NETDFLIGINEESVEGTAIYLPGPDRCKMNPCLNGGTCYPTETSYVCTCVPGYSGDQCELDFDECHSNPCRNGATCV
DGFNTFRCLCLPSYVGALCEQDTETCDYGWHKFQGQCYKYFAHRRTWDAAERECRLQGAHLTSILSHEEQMFVNRVG
HDYQWIGLNDKMFEHDFRWTDGSTLQYENWRPNQPDSFFSAGEDCVVIIWHENGQWNDVPCNYHLTYTCKKGTVACG
QPPVVENAKTFGKMKPRYEINSLIRYHCKDGFIQRHLPTIRCLGNGRWAIPKITCMNPSAYQRTYSMKYFKNSSSAK
DNSINTSKHDHRWSRRWQESRR

Signal sequence.
amino acids 1-20

N-glycosylation sites.
amino acids 57-60, 330-333, 411-414, 455-458, 481-484, 676-679, 911-914, 1192-1195, 1285-1288, 1293-1296, 1373-1376, 1398-1402, 1405-1408, 1509-1512, 1641-1644, 1947-1950, 2080-2083, 2382-2385, 2392-2395

FIGURE 184B

Glycosaminoglycan attachment sites.
amino acids 1267-1270, 1442-1445 cAMP- and cGMP-dependent protein kinase phosphorylation sites.
amino acids 348-352, 1069-1072, 1550-1553, 2303-2306

Tyrosine kinase phosphorylation sites.
amino acids 288-296, 924-930, 1433-1439

N-myristoylation sites.
amino acids 34-39, 126-131, 135-140, 176-181, 317-322, 445-450, 654-659, 743-748, 746-751, 781-786, 816-821, 829-834, 849-854, 897-902, 971-976, 1048-1053, 1095-1100, 1252-1257, 1268-1273, 1338-1343, 1741-1746, 1781-1786, 1847-1852, 1864-1869, 1951-1956, 1970-1975, 1998-2003, 2034-2039, 2214-2219, 2305-2310

Aspartic acid and asparagine hydroxylation site.
amino acids 2155-2166

EGF-like domain cysteine pattern signature.
amino acids 2126-2137, 2164-2175

C-type lectin domain signature.
amino acids 2278-2302

Extracellular link domains.
amino acids 149-244, 250-346

Lectin C-type domain.
amino acids 2199-2304

EGF-like domains.
amino acids 2106-2137, 2144-2175

Sushi domain (SCR repeat).
amino acids 2309-2365

FIGURE 185

MASPSRRLQTKPVITCFKSVLLIYTFIFWITGVILLAVGIWGKVSLENYFSLLNEKATNVPFVLIATGTVIILLGTF
GCFATCRASAWMLKLYAMFLTLVFLVELVAAIVGFVFRHEIKNSFKNNYEKALKQYNSTGDYRSHAVDKIQNTLHCC
GVTDYRDWTDTNYYSEKGFPKSCCKLEDCTPQRDADKVNNEGCFIKVMTIIESEMGVVAGISFGVACFQLIGIFLAY
CXSRAITNNQYEIV

Signal sequence.
amino acids 1-42

N-glycosylation site.
amino acids 134-137

Tyrosine kinase phosphorylation site.
amino acids 160-168

N-myristoylation sites.
amino acids 75-80, 78-83, 210-215, 214-219, 226-231

Tetraspanin family.
amino acids 18-237

FIGURE 186

MPSAGTLPWVQGIICNANNPCFRYPTPGEAPGVVGNFNKSIVARLFSDARRLLLYSQKDTSMKDMRKVLRTLQQIKK
SSSNLKLQDFLVDNETFSGFLYHNLSLPKSTVDKMLRADVILHKVFLQGYQLHLTSLCNGSKSEEMIQLGDQEVSEL
CGLPREKLAAAERVLRSNMDILKPILRTLNSTSPFPSKELAEATKTLLHSLGTLAQELFSMRSWSDMRQEVMFLTNV
NSSSSSTQIYQAVSRIVCGHPEGGGLKIKSLNWYEDNNYKALFGGNGTEEDAETFYDNSTTPYCNDLMKNLESSPLS
RIIWKALKPLLVGKILYTPDTPATRQVMAEVNKTFQELAVFHDLEGMWEELSPKIWTFMENSQEMDLVRMLLDSRDN
DHFWEQQLDGLDWTAQDIVAFLAKHPEDVQSSNGSVYTWREAFNETNQAIRTISRFMECVNLNKLEPIATEVWLINK
SMELLDERKFWAGIVFTGITPGSIELPHHVKYKIRMDIDNVERTNKIKDGYWDPGPRADPFEDMRYVWGGFAYLQDV
VEQAIIRVLTGTEKKTGVYMQQMPYPCYVDDIFLRVMSRSMPLFMTLAWIYSVAVIIKGIVYEKEARLKETMRIMGL
DNSILWFSWFISSLIPLLVSAGLLVVILKLGNLLPYSDPSVVFVFLSVFAVVTILQCFLISTLFSRANLAAACGGII
YFTLYLPYVLCVAWQDYVGFTLKIFASLLSPVAFGFGCEYFALFEEQGIGVQWDNLFESPVEEDGFNLTTSVSMMLF
DTFLYGVMTWYIEAVFPGQYGIPRPWYFPCTKSYWFGEESDEKSHPGSNQKRISEICMEEEPTHLKLGVSIQNLVKV
YRDGMKVAVDGLALNFYEGQITSFLGHNGAGKTTTMSILTGLFPPTSGTAYILGKDIRSEMSTIRQNLGVCPQHNVL
FDMLTVEEHIWFYARLKGLSEKHVKAEMEQMALDVGLPSSKLKSKTSQLSGGMQRKLSVALAFVGGSKVVILDEPTA
GVDPYSRRGIWELLLKYRQGRTIILSTHHMDEADVLGDRIAIISHGKLCCVGSSLFLKNQLGTGYYLTLVKKDVESS
LSSCRNSSSTVSYLKKEDSVSQSSSDAGLGSDHESDTLTIDVSAISNLIRKHVSEARLVEDIGHELTYVLPYEAAKE
GAFVELFHEIDDRLSDLGISSYGISETTLEEIFLKVAEESGVDAETSDGTLPARRNRRAFGDKQSCLRPFTEDDAAD
PNDSDIDPESRETDLLSGMDGKGSYQVKGWKLTQQQFVALLWKRLLIARRSRKGFFAQIVLPAVFVCIALVFSLIVP
PFGKYPSLELQPWMYNEQYTFVSNDAPEDTGTLELLNALTKDPGFGTRCMEGNPIPDTPCQAGEEEWTTAPVPQTIM
DLFQNGNWTMQNPSPACQCSSDKIKKMLPVCPPGAGGLPPPQRKQNTADILQDLTGRNISDYLVKTYVQIIAKSLKN
KIWVNEFRYGGFSLGVSNTQALPPSQEVNDATKQMKKHLKLAKDSSADRFLNSLGRFMTGLDTRNNVKVWFNNKGWH
AISSFLNVINNAILRANLQKGENPSHYGITAFNHPLNLTKQQLSEVAPMTTSVDVLVSICVIFAMSFVPASFVVFLI
QERVSKAKHLQFISGVKPVIYWLSNFVWDMCNYVVPATLVIIIFICFQQKSYVSSTNLPVLALLLLLYGWSITPLMY
PASFVFKIPSTAYVVLTSVNLFIGINGSVATFVLELFTDNKLNNINDILKSVFLIFPHFCLGRGLIDMVKNQAMADA
LERFGENRFVSPLSWDLVGRNLFAMAVEGVVFFLITVLIQYRFFIRPRPVNAKLSPLNDEDEDVRRERQRILDGGGQ
NDILEIKELTKIYRRKRKPAVDRICVGIPPGECFGLLGVNGAGKSSTFKMLTGDTTVTRGDAFLNRNSILSNIHEVH
QNMGYCPQFDAITELLTGREHVEFFALLRGVPEKEVGKVGEWAIRKLGLVKYGEKYAGNYSGGNKRKLSTAMALIGG
PPVVFLDEPTTGMDPKARRFLWNCALSVVKEGRSVVLTSHSMEECEALCTRMAIMVNGRFRCLGSVQHLKNRFGDGY
TIVVRIAGSNPDLKPVQDFFGLAFPGSVPKEKHRNMLQYQLPSSLSSLARIFSILSQSKKRLHIEDYSVSQTTLDQV
FVNFAKDQSDDDHLKDLSLHKNQTVVDVAVLTSFLQDEKVKESYV

Transmembrane domains.
amino acids 576-596, 623-643, 649-669, 665-685, 692-712, 709-729, 761-781, 1288-1308, 1593-1613, 1637-1657, 1671-1691, 1706-1726, 1741-1761, 1789-1809
N-glycosylation sites.
amino acids 38-41, 91-94, 101-104, 136-139, 184-187, 232-235, 277-280, 289-292, 340-343, 418-421, 429-432, 461-464, 760-763, 1084-1087, 1234-1237, 1393-1396, 1444-1447, 1577-1580, 1720-1723, 1984-1987, 2178-2181
cAMP- and cGMP-dependent protein kinase phosphorylation sites.
amino acids 76-79, 821-824, 979-982, 1991-1994
N-myristoylation sites.
amino acids 12-17, 32-37, 275-280, 395-400, 419-424, 475-480, 480-485, 615-620, 851-856, 858-863, 866-871, 876-881, 960-965, 1178-1183, 1204-1209, 1478-1483, 1718-1723, 1721-1726, 1845-1850, 1875-1880, 1886-1891, 1889-1894, 1983-1988
Cell attachment sequence.
amino acids 1907-1909
ATP/GTP-binding site motif A (P-loop).
amino acids 873-880, 1886-1893
Leucine zipper pattern.
amino acids 162-183, 2120-2141
ABC transporter.
amino acids 866-1047, 1879-2060

FIGURE 187

MPVKGGTKCIKYLLFGFNFIFWLAGIAVLAIGLWLRFDSQTKSIFEQETNNNNSSFYTGVYILIGAGALMMLVGFLG
CCGAVQESQCMLGLFFGFLLVIFAIEIAAAIWGYSHKDEVIKEVQEFYKDTYNKLKTKDEPQRETLKAIHYALNCCG
LAGGVEQFISDICPKKDVLETFTVKSCPDAIKEVFDNKFHIIGAVGIGIAVVMIFGMIFSMILCCAIRRNREMV

Transmembrane domains.
amino acids 14-34, 54-74, 88-108, 193-213

N-glycosylation sites.
amino acids 52-55, 53-56

N-myristoylation sites.
amino acids 5-10, 77-82, 90-95, 154-159, 200-205, 210-215

Tetraspanin family.
amino acids 11-221

FIGURE 188

MTPQSLLQTTLFLLSLLFLVQGAHGRGHREDFRFCSQRNQTHRSSLHYKPTPDLRISIENSEEALTVHAPFPAAHPA
SRSFPDPRGLYHFCLYWNRHAGRLHLLYGKRDFLLSDKASSLLCFQHQEESLAQGPPLLATSVTSWWSPQNISLPSA
ASFTFSFHSPPHTAAHNASVDMCELKRDLQLLSQFLKHPQKASRRPSAAPASQQLQSLESKLTSVRFMGDMVSFEED
RINATVWKLQPTAGLQDLHIHSRQEEEQSEIMEYSVLLPRTLFQRTKGRSGEAEKRLLLVDFSSQALFQDKNSSQVL
GEKVLGIVVQNTKVANLTEPVVLTFQHQLQPKNVTLQCVFWVEDPTLSSPGHWSSAGCETVRRETQTSCFCNHLTYF
AVLMVSSVEVDAVHKHYLSLLSYVGCVVSALACLVTIAAYLCSRVPLPCRRKPRDYTIKVHMNLLLAVFLLDTSFLL
SEPVALTGSEAGCRASAIFLHFSLLTCLSWMGLEGYNLYRLVVEVFGTYVPGYLLKLSAMGWGFPIFLVTLVALVDV
DNYGPIILAVHRTPEGVIYPSMCWIRDSLVSYITNLGLFSLVFLFNMAMLATMVVQILRLRPHTQKWSHVLTLLGLS
LVLGLPWALIFFSFASGTFQLVVLYLFSIITSFQGFLIFIWYWSMRLQARGGPSPLKSNSDSARLPISSGSTSSSRI

Transmembrane domains.
amino acids 406-426, 443-463, 481-501, 523-543, 570-590, 607-627, 641-661

Signal sequence.
amino acids 1-24

N-glycosylation sites.
amino acids 39-44, 148-153, 171-174, 234-237, 303-306, 324-327, 341-344 cAMP- and cGMP-dependent protein kinase phosphorylation sites.
amino acids 198-201, 370-373

Tyrosine kinase phosphorylation site.
amino acids 551-558

N-myristoylation sites.
amino acids 410-415, 470-475, 474-479, 620-625, 686-691

Amidation site.
amino acids 105-108

Microbodies C-terminal targeting signal.
amino acids 691-694

Transmembrane receptor (Secretin family).
amino acids 400-665

Latrophilin/CL-1-like GPS domain.
amino acids 342-394

FIGURE 189

MRAWIFFLLCLAGRALAAPQQEALPDETEVVEETVAEVTEVSVGANPVQVEVGEFDDGAEETEEEVVAENPCQNHHC
KHGKVCELDENNTPMCVCQDPTSCPAPIGEFEKVCSNDNKTFDSSCHFFATKCTLEGTKKGHKLHLDYIGPCKYIPP
CLDSELTEFPLRMRDWLKNVLVTLYERDEDNNLLTEKQKLRVKKIHENEKRLEAGDHPVELLARDFEKNYNMYIFPV
HWQFGQLDQHPIDGYLSHTELAPLRAPLIPMEHCTTRFFETCDLDNDKYIALDEWAGCFGIKQKDIDKDLVI

Signal sequence.
amino acids 1-17

N-glycosylation site.
amino acids 116-119

Protein kinase C phosphorylation sites.
amino acids 135-137, 189-191, 266-268

Casein kinase II phosphorylation sites.
amino acids 34-37, 62-65, 177-180, 248-251

Tyrosine kinase phosphorylation site.
amino acids 218-224

N-myristoylation site.
amino acids 58-63, 134-139

Osteonectin domain signature 1.
amino acids 72-102

Osteonectin domain signature 2.
amino acids 163-173

Kazal-type serine protease inhibitor domain.
amino acids 95-149

FIGURE 190

MVLLEDSGSADFRRHFVNLSPFTITVVLLLSACFVTSSLGGTDKELRLVDGENKCSGRVEVKVQEEWGTVCNNGWSM
EAVSVICNQLGCPTAIKAPGWANSSAGSGRIWMDHVSCRGNESALWDCKHDGWGKHSNCTHQQDAGVTCSDGSNLEM
RLTRGGNMCSGRIEIKFQGRWGTVCDDNFNIDHASVICRQLECGSAVSFSGSSNFGEGSGPIWFDDLICNGNESALW
NCKHQGWGKHNCDHAEDAGVICSKGADLSLRLVDGVTECSGRLEVRFQGEWGTICDDGWDSYDAAVACKQLGCPTAV
TAIGRVNASKGFGHIWLDSVSCQGHEPAVWQCKHHEWGKHYCNHNEDAGVTCSDGSDLELRLRGGGSRCAGTVEVEI
QRLLGKVCDRGWGLKEADVVCRQLGCGSALKTSYQVYSKIQATNTWLFLSSCNGNETSLWDCKNWQWGGLTCDHYEE
AKITCSAHREPRLVGGDIPCSGRVEVKHGDTWGSICDSDFSLEAASVLCRELQCGTVVSILGGAHFGEGNGQIWAEE
FQCEGHESHLSLCPVAPRPEGTCSHSRDVGVVCSRYTEIRLVNGKTPCEGRVELKTLGAWGSLCNSHWDIEDAHVLC
QQLKCGVALSTPGGARFGKGNGQIWRHMFHCTGTEQHMGDCPVTALGASLCPSEQVASVICSGNQSQTLSSCNSSSL
GPTRPTIPEESAVACIESGQLRLVNGGGRCAGRVEIYHEGSWGTICDDSWDLSDAHVVCRQLGCGEAINATGSAHFG
EGTGPIWLDEMKCNGKESRIWQCHSHGWGQQNCRHKEDAGVICSEFMSLRLTSEASREACAGRLEVFYNGAWGTVGK
SSMSETTVGVVCRQLGCADKGKINPASLDKAMSIPMWVDNVQCPKGPDTLWQCPSSPWEKRLASPSEETWITCDNKI
RLQEGPTSCSGRVEIWHGGSWGTVCDDSWDLDDAQVVCQQLGCGPALKAFKEAEFGQGTGPIWLNEVKCKGNESSLW
DCPARRWGHSECGHKEDAAVNCTDISVQKTPQKATTGRSSRQSSFIAVGILGVVLLAIFVALFFLTKKRRQRQRLAV
SSRGENLVHQIQYREMNSCLNADDLDLMNSSGGHSEPH

Transmembrane domain:
amino acids 1044-1066

N-glycosylation sites.
amino acids 100-103, 118-121, 135-138, 226-229, 315-318, 440-443, 680-683, 689-692, 762-765, 996-999, 1022-1025, 1107-1110

N-myristoylation sites.
amino acids 68-73, 88-93, 117-122, 143-148, 159-164, 160-165, 198-203, 225-230, 250-255, 256-261, 266-271, 303-308, 357-362, 373-378, 374-379, 398-403, 410-415, 439-444, 453-458, 517-522, 525-530, 533-538, 569-574, 597-602, 600-605, 622-627, 630-635, 719-724, 720-725, 733-738, 756-761, 799-804, 810-815, 840-845, 942-947, 943-948, 966-971, 995-1000

Prokaryotic membrane lipoprotein lipid attachment site.
amino acids 23-33, 427-437, 678-688

ATP/GTP-binding site motif A (P-loop).
amino acids 841-848

Speract receptor repeated domain signature.
amino acids 51-88, 266-303, 719-756, 929-966

COMPOSITIONS AND METHODS FOR THE DIAGNOSIS AND TREATMENT OF TUMORS OF GLIAL ORIGIN

This application is a continuation of U.S. application Ser. No. 10/852,335, filed May 24, 2004 which claims benefit of U.S. Provisional Patent Application No. 60/548,299, filed Feb. 27, 2004 and U.S. Provisional Patent Application No. 60/473,238, filed May 23, 2003, the entire disclosures of which are hereby incorporated by reference.

FIELD OF THE INVENTION

The present invention is directed to compositions of matter useful for the diagnosis and treatment of tumors of glial origin in mammals and to methods of using those compositions of matter for the same.

BACKGROUND OF THE INVENTION

Malignant tumors (cancers) are the second leading cause of death in the United States, after heart disease (Boring et al., *CA Cancel J. Clin.* 43:7 (1993)). Cancer is characterized by the increase in the number of abnormal, or neoplastic, cells derived from a normal tissue which proliferate to form a tumor mass, the invasion of adjacent tissues by these neoplastic tumor cells, and the generation of malignant cells which eventually spread via the blood or lymphatic system to regional lymph nodes and to distant sites via a process called metastasis. In a cancerous state, a cell proliferates under conditions in which normal cells would not grow. Cancer manifests itself in a wide variety of forms, characterized by different degrees of invasiveness and aggressiveness.

In attempts to discover effective cellular targets for cancer diagnosis and therapy, researchers have sought to identify transmembrane or otherwise membrane-associated polypeptides that are specifically expressed on the surface of one or more particular type(s) of cancer cell as compared to on one or more normal non-cancerous cell(s). Often, such membrane-associated polypeptides are more abundantly expressed on the surface of the cancer cells as compared to on the surface of the non-cancerous cells. The identification of such tumor-associated cell surface antigen polypeptides has given rise to the ability to specifically target cancer cells for destruction via antibody-based therapies. In this regard, it is noted that antibody-based therapy has proved very effective in the treatment of certain cancers. For example, HERCEPTIN® and RITUXAN® (both from Genentech Inc., South San Francisco, Calif.) are antibodies that have been used successfully to treat breast cancer and non-Hodgkin's lymphoma, respectively. More specifically, HERCEPTIN® is a recombinant DNA-derived humanized monoclonal antibody that selectively binds to the extracellular domain of the human epidermal growth factor receptor 2 (HER2) proto-oncogene. HER2 protein overexpression is observed in 25-30% of primary breast cancers. RITUXAN® is a genetically engineered chimeric murine/human monoclonal antibody directed against the CD20 antigen found on the surface of normal and malignant B lymphocytes. Both these antibodies are recombinantly produced in CHO cells.

In other attempts to discover effective cellular targets for cancer diagnosis and therapy, researchers have sought to identify (1) non-membrane-associated polypeptides that are specifically produced by one or more particular type(s) of cancer cell(s) as compared to by one or more particular type(s) of non-cancerous normal cell(s), (2) polypeptides that are produced by cancer cells at an expression level that is significantly higher than that of one or more normal non-cancerous cell(s), or (3) polypeptides whose expression is specifically limited to only a single (or very limited number of different) tissue type(s) in both the cancerous and non-cancerous state (e.g., normal prostate and prostate tumor tissue). Such polypeptides may remain intracellularly located or may be secreted by the cancer cell. Moreover, such polypeptides may be expressed not by the cancer cell itself, but rather by cells which produce and/or secrete polypeptides having a potentiating or growth-enhancing effect on cancer cells. Such secreted polypeptides are often proteins that provide cancer cells with a growth advantage over normal cells and include such things as, for example, angiogenic factors, cellular adhesion factors, growth factors, and the like. Identification of antagonists of such non-membrane associated polypeptides would be expected to serve as effective therapeutic agents for the treatment of such cancers. Furthermore, identification of the expression pattern of such polypeptides would be useful for the diagnosis of particular cancers in mammals.

Despite the above identified advances in mammalian cancer therapy, there is a great need for additional diagnostic and therapeutic agents capable of detecting the presence of tumor in a mammal and for effectively inhibiting neoplastic cell growth, respectively. Accordingly, it is an objective of the present invention to identify: (1) cell membrane-associated polypeptides that are more abundantly expressed on one or more type(s) of cancer cell(s) as compared to on normal cells or on other different cancer cells, (2) non-membrane associated polypeptides that are specifically produced by one or more particular type(s) of cancer cell(s) (or by other cells that produce polypeptides having a potentiating effect on the growth of cancer cells) as compared to by one or more particular type(s) of non-cancerous normal cell(s), (3) non-membrane-associated polypeptides that are produced by cancer cells at an expression level that is significantly higher than that of one or more normal non-cancerous cell(s), or (4) polypeptides whose expression is specifically limited to only a single (or very limited number of different) tissue type(s) in both a cancerous and non-cancerous state (e.g., normal prostate and prostate tumor tissue), and to use those polypeptides, and their encoding nucleic acids, to produce compositions of matter useful in the therapeutic treatment and diagnostic detection of cancer in mammals. It is also an objective of the present invention to identify cell membrane-associated, secreted or intracellular polypeptides whose expression is limited to a single or very limited number of tissues, and to use those polypeptides, and their encoding nucleic acids, to produce compositions of matter useful in the therapeutic treatment and diagnostic detection of cancer in mammals.

SUMMARY OF THE INVENTION

A. Embodiments

In the present specification, Applicants describe for the first time the identification of various cellular polypeptides (and their encoding nucleic acids or fragments thereof) which are expressed to a greater degree on the surface of or by one or more types of cancer cell(s) (e.g., cancer cells of glial origin) as compared to on the surface of or by one or more types of normal non-cancer cells (e.g., normal glial cells). Alternatively, such polypeptides are expressed by cells which produce and/or secrete polypeptides having a potentiating or growth-enhancing effect on cancer cells. Again alternatively, such polypeptides may not be overexpressed by tumor cells as compared to normal cells of the same tissue type, but rather may be specifically expressed by both tumor cells and normal cells of only a single or very limited number of tissue types (preferably tissues which are not essential for life, e.g., prostate, etc.). All of the above polypeptides are herein referred to as Tumor-associated Antigenic Target polypeptides ("TAT" polypeptides) and are expected to serve as effective targets for cancer therapy and diagnosis in mammals.

Accordingly, in one embodiment of the present invention, the invention provides an isolated nucleic acid molecule having a nucleotide sequence that encodes a tumor-associated antigenic target polypeptide or fragment thereof (a "TAT" polypeptide).

In certain aspects, the isolated nucleic acid molecule comprises a nucleotide sequence having at least about 80% nucleic acid sequence identity, alternatively at least about 81%, 82%, 83%, 84%, 85%, 86%, 87%, 88%, 89%, 90%, 91%, 92%, 93%, 94%, 95%, 96%, 97%, 98%, 99% or 100% nucleic acid sequence identity, to (a) a DNA molecule encoding a full-length TAT polypeptide having an amino acid sequence as disclosed herein, a TAT polypeptide amino acid sequence lacking the signal peptide as disclosed herein, an extracellular domain of a transmembrane TAT polypeptide, with or without the signal peptide, as disclosed herein or any other specifically defined fragment of a full-length TAT polypeptide amino acid sequence as disclosed herein, or (b) the complement of the DNA molecule of (a).

In other aspects, the isolated nucleic acid molecule comprises a nucleotide sequence having at least about 80% nucleic acid sequence identity, alternatively at least about 81%, 82%, 83%, 84%, 85%, 86%, 87%, 88%, 89%, 90%, 91%, 92%, 93%, 94%, 95%, 96%, 97%, 98%, 99% or 100% nucleic acid sequence identity, to (a) a DNA molecule comprising the coding sequence of a full-length TAT polypeptide cDNA as disclosed herein, the coding sequence of a TAT polypeptide lacking the signal peptide as disclosed herein, the coding sequence of an extracellular domain of a transmembrane TAT polypeptide, with or without the signal peptide, as disclosed herein or the coding sequence of any other specifically defined fragment of the full-length TAT polypeptide amino acid sequence as disclosed herein, or (b) the complement of the DNA molecule of (a).

In further aspects, the invention concerns an isolated nucleic acid molecule comprising a nucleotide sequence having at least about 80% nucleic acid sequence identity, alternatively at least about 81%, 82%, 83%, 84%,85%,86%,87%, 88%,89%,90%,91%,92%, 93%, 94%, 95%, 96%, 97%, 98%, 99% or 100% nucleic acid sequence identity, to (a) a DNA molecule that encodes the same mature polypeptide encoded by the full-length coding region of any of the human protein cDNAs deposited with the ATCC as disclosed herein, or (b) the complement of the DNA molecule of (a).

Another aspect of the invention provides an isolated nucleic acid molecule comprising a nucleotide sequence encoding a TAT polypeptide which is either transmembrane domain-deleted or transmembrane domain-inactivated, or is complementary to such encoding nucleotide sequence, wherein the transmembrane domain(s) of such polypeptide(s) are disclosed herein. Therefore, soluble extracellular domains of the herein described TAT polypeptides are contemplated.

In other aspects, the present invention is directed to isolated nucleic acid molecules which hybridize to (a) a nucleotide sequence encoding a TAT polypeptide having a full-length amino acid sequence as disclosed herein, a TAT polypeptide amino acid sequence lacking the signal peptide as disclosed herein, an extracellular domain of a transmembrane TAT polypeptide, with or without the signal peptide, as disclosed herein or any other specifically defined fragment of a full-length TAT polypeptide amino acid sequence as disclosed herein, or (b) the complement of the nucleotide sequence of (a). In this regard, an embodiment of the present invention is directed to fragments of a full-length TAT polypeptide coding sequence, or the complement thereof, as disclosed herein, that may find use as, for example, hybridization probes useful as, for example, diagnostic probes, antisense oligonucleotide probes, or for encoding fragments of a full-length TAT polypeptide that may optionally encode a polypeptide comprising a binding site for an anti-TAT polypeptide antibody, a TAT binding oligopeptide or other small organic molecule that binds to a TAT polypeptide. Such nucleic acid fragments are usually at least about 5 nucleotides in length, alternatively at least about 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleotides in length, wherein in this context the term "about" means the referenced nucleotide sequence length plus or minus 10% of that referenced length. It is noted that novel fragments of a TAT polypeptide-encoding nucleotide sequence may be determined in a routine manner by aligning the TAT polypeptide-encoding nucleotide sequence with other known nucleotide sequences using any of a number of well known sequence alignment programs and determining which TAT polypeptide-encoding nucleotide sequence fragment(s) are novel. All of such novel fragments of TAT polypeptide-encoding nucleotide sequences are contemplated herein. Also contemplated are the TAT polypeptide fragments encoded by these nucleotide molecule fragments, preferably those TAT polypeptide fragments that comprise a binding site for an anti-TAT antibody, a TAT binding oligopeptide or other small organic molecule that binds to a TAT polypeptide.

In another embodiment, the invention provides isolated TAT polypeptides encoded by any of the isolated nucleic acid sequences hereinabove identified.

In a certain aspect, the invention concerns an isolated TAT polypeptide, comprising an amino acid sequence having at least about 80% amino acid sequence identity, alternatively at least about 81%, 82%, 83%, 84%, 85%, 86%, 87%, 88%, 89%, 90%, 91%, 92%, 93%, 94%, 95%, 96%, 97%, 98%, 99% or 100% amino acid sequence identity, to a TAT polypeptide having a full-length amino acid sequence as disclosed herein, a TAT polypeptide amino acid sequence lacking the signal peptide as disclosed herein, an extracellular domain of a transmembrane TAT polypeptide protein, with or without the signal peptide, as disclosed herein, an amino acid sequence encoded by any of the nucleic acid sequences disclosed herein or any other specifically defined fragment of a full-length TAT polypeptide amino acid sequence as disclosed herein.

In a further aspect, the invention concerns an isolated TAT polypeptide comprising an amino acid sequence having at least about 80% amino acid sequence identity, alternatively at least about 81%, 82%, 83%, 84%, 85%, 86%, 87%, 88%, 89%, 90%, 91%, 92%, 93%, 94%, 95%, 96%, 97%, 98%, or 99% amino acid sequence identity, to an amino acid sequence encoded by any of the human protein cDNAs deposited with the ATCC as disclosed herein.

In a specific aspect, the invention provides an isolated TAT polypeptide without the N-terminal signal sequence and/or without the initiating methionine and is encoded by a nucleotide sequence that encodes such an amino acid sequence as hereinbefore described. Processes for producing the same are also herein described, wherein those processes comprise culturing a host cell comprising a vector which comprises the appropriate encoding nucleic acid molecule under conditions suitable for expression of the TAT polypeptide and recovering the TAT polypeptide from the cell culture.

Another aspect of the invention provides an isolated TAT polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the TAT polypeptide and recovering the TAT polypeptide from the cell culture.

In other embodiments of the present invention, the invention provides vectors comprising DNA encoding any of the herein described polypeptides. Host cells comprising any such vector are also provided. By way of example, the host cells may be CHO cells, *E. coli* cells, or yeast cells. A process for producing any of the herein described polypeptides is further provided and comprises culturing host cells under conditions suitable for expression of the desired polypeptide and recovering the desired polypeptide from the cell culture.

In other embodiments, the invention provides isolated chimeric polypeptides comprising any of the herein described TAT polypeptides fused to a heterologous (non-TAT) polypeptide. Example of such chimeric molecules comprise any of the herein described TAT polypeptides fused to a heterologous polypeptide such as, for example, an epitope tag sequence or a Fc region of an immunoglobulin.

In another embodiment, the invention provides an antibody which binds, preferably specifically, to any of the above or below described polypeptides. Optionally, the antibody is a monoclonal antibody, antibody fragment, chimeric antibody, humanized antibody, single-chain antibody or antibody that competitively inhibits the binding of an anti-TAT polypeptide antibody to its respective antigenic epitope. Antibodies of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies of the present invention may optionally be produced in CHO cells or bacterial cells and preferably induce death of a cell to which they bind. For diagnostic purposes, the antibodies of the present invention may be detectably labeled, attached to a solid support, or the like.

In other embodiments of the present invention, the invention provides vectors comprising DNA encoding any of the herein described antibodies. Host cell comprising any such vector are also provided. By way of example, the host cells may be CHO cells, *E. coli* cells, or yeast cells. A process for producing any of the herein described antibodies is further provided and comprises culturing host cells under conditions suitable for expression of the desired antibody and recovering the desired antibody from the cell culture.

In another embodiment, the invention provides oligopeptides ("TAT binding oligopeptides") which bind, preferably specifically, to any of the above or below described TAT polypeptides. Optionally, the TAT binding oligopeptides of the present invention may be conjugated to a growth inhibitory agent or cytotoxic agent such as a toxin, including, for example, a maytansinoid or calicheamicin, an antibiotic, a radioactive isotope, a nucleolytic enzyme, or the like. The TAT binding oligopeptides of the present invention may optionally be produced in CHO cells or bacterial cells and preferably induce death of a cell to which they bind. For diagnostic purposes, the TAT binding oligopeptides of the present invention may be detectably labeled, attached to a solid support, or the like.

In other embodiments of the present invention, the invention provides vectors comprising DNA encoding any of the herein described TAT binding oligopeptides. Host cell comprising any such vector are also provided. By way of example, the host cells may be CHO cells, *E. coli* cells, or yeast cells. A process for producing any of the herein described TAT binding oligopeptides is further provided and comprises culturing host cells under conditions suitable for expression of the desired oligopeptide and recovering the desired oligopeptide from the cell culture.

In another embodiment, the invention provides small organic molecules ("TAT binding organic molecules") which bind, preferably specifically, to any of the above or below described TAT polypeptides. Optionally, the TAT binding organic molecules of the present invention may be conjugated to a growth inhibitory agent or cytotoxic agent such as a toxin, including, for example, a maytansinoid or calicheamicin, an antibiotic, a radioactive isotope, a nucleolytic enzyme, or the like. The TAT binding organic molecules of the present invention preferably induce death of a cell to which they bind. For diagnostic purposes, the TAT binding organic molecules of the present invention may be detectably labeled, attached to a solid support, or the like.

In a still further embodiment, the invention concerns a composition of matter comprising a TAT polypeptide as described herein, a chimeric TAT polypeptide as described herein, an anti-TAT antibody as described herein, a TAT binding oligopeptide as described herein, or a TAT binding organic molecule as described herein, in combination with a carrier. Optionally, the carrier is a pharmaceutically acceptable carrier.

In yet another embodiment, the invention concerns an article of manufacture comprising a container and a composition of matter contained within the container, wherein the composition of matter may comprise a TAT polypeptide as described herein, a chimeric TAT polypeptide as described herein, an anti-TAT antibody as described herein, a TAT binding oligopeptide as described herein, or a TAT binding organic molecule as described herein. The article may further optionally comprise a label affixed to the container, or a package insert included with the container, that refers to the use of the composition of matter for the therapeutic treatment or diagnostic detection of a tumor.

Another embodiment of the present invention is directed to the use of a TAT polypeptide as described herein, a chimeric TAT polypeptide as described herein, an anti-TAT polypeptide antibody as described herein, a TAT binding oligopeptide as described herein, or a TAT binding organic molecule as described herein, for the preparation of a medicament useful in the treatment of a condition which is responsive to the TAT polypeptide, chimeric TAT polypeptide, anti-TAT polypeptide antibody, TAT binding oligopeptide, or TAT binding organic molecule.

B. Additional Embodiments

Another embodiment of the present invention is directed to a method for inhibiting the growth of a cell that expresses a TAT polypeptide, wherein the method comprises contacting the cell with an antibody, an oligopeptide or a small organic molecule that binds to the TAT polypeptide, and wherein the binding of the antibody, oligopeptide or organic molecule to the TAT polypeptide causes inhibition of the growth of the cell expressing the TAT polypeptide. In preferred embodiments, the cell is a cancer cell of glial origin and binding of the antibody, oligopeptide or organic molecule to the TAT polypeptide causes death of the cell expressing the TAT polypeptide. Optionally, the antibody is a monoclonal antibody, antibody fragment, chimeric antibody, humanized antibody, or single-chain antibody. Antibodies, TAT binding oligopeptides and TAT binding organic molecules employed in the methods of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies and TAT binding oligopeptides employed in the methods of the present invention may optionally be produced in CHO cells or bacterial cells.

Yet another embodiment of the present invention is directed to a method of therapeutically treating a mammal having a cancerous tumor comprising cells that express a TAT polypeptide, wherein the method comprises administering to the mammal a therapeutically effective amount of an antibody, an oligopeptide or a small organic molecule that binds to the TAT polypeptide, thereby resulting in the effective therapeutic treatment of the tumor. In a preferred embodiment, the cells are cancerous cells of glial origin. Optionally, the antibody is a monoclonal antibody, antibody fragment, chimeric antibody, humanized antibody, or single-chain antibody. Antibodies, TAT binding oligopeptides and TAT binding organic molecules employed in the methods of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies and oligopeptides employed in the methods of the present invention may optionally be produced in CHO cells or bacterial cells.

Yet another embodiment of the present invention is directed to a method of determining the presence of a TAT polypeptide in a sample suspected of containing the TAT polypeptide, wherein the method comprises exposing the sample to an antibody, oligopeptide or small organic molecule that binds to the TAT polypeptide and determining binding of the antibody, oligopeptide or organic molecule to the TAT polypeptide in the sample, wherein the presence of such binding is indicative of the presence of the TAT polypeptide in the sample. Optionally, the sample may contain cells (which may be cancer cells of glial origin) suspected of expressing the TAT polypeptide. The antibody, TAT binding oligopeptide or TAT binding organic molecule employed in the method may optionally be detectably labeled, attached to a solid support, or the like.

A further embodiment of the present invention is directed to a method of diagnosing the presence of a tumor in a mammal, wherein the method comprises detecting the level of expression of a gene encoding a TAT polypeptide (a) in a test sample of tissue cells obtained from said mammal, and (b) in a control sample of known normal non-cancerous cells of the same tissue origin or type, wherein a higher level of expression of the TAT polypeptide in the test sample, as compared to the control sample, is indicative of the presence of tumor in the mammal from which the test sample was obtained. In a preferred embodiment, the tumor is a tumor of glial origin.

Another embodiment of the present invention is directed to a method of diagnosing the presence of a tumor in a mammal, wherein the method comprises (a) contacting a test sample comprising tissue cells obtained from the mammal with an antibody, oligopeptide or small organic molecule that binds to a TAT polypeptide and (b) detecting the formation of a complex between the antibody, oligopeptide or small organic molecule and the TAT polypeptide in the test sample, wherein the formation of a complex is indicative of the presence of a tumor in the mammal. Optionally, the antibody, TAT binding oligopeptide or TAT binding organic molecule employed is detectably labeled, attached to a solid support, or the like, and/or the test sample of tissue cells is obtained from an individual suspected of having a cancerous tumor.

Yet another embodiment of the present invention is directed to a method for treating or preventing a cell proliferative disorder associated with altered, preferably increased, expression or activity of a TAT polypeptide, the method comprising administering to a subject in need of such treatment an effective amount of an antagonist of a TAT polypeptide. Preferably, the cell proliferative disorder is cancer and the antagonist of the TAT polypeptide is an anti-TAT polypeptide antibody, TAT binding oligopeptide, TAT binding organic molecule or antisense oligonucleotide. Effective treatment or prevention of the cell proliferative disorder may be a result of direct killing or growth inhibition of cells that express a TAT polypeptide or by antagonizing the cell growth potentiating activity of a TAT polypeptide. In a preferred embodiment, the cell proliferative disorder is a tumor of glial origin.

Yet another embodiment of the present invention is directed to a method of binding an antibody, oligopeptide or small organic molecule to a cell that expresses a TAT polypeptide, wherein the method comprises contacting a cell that expresses a TAT polypeptide with said antibody, oligopeptide or small organic molecule under conditions which are suitable for binding of the antibody, oligopeptide or small organic molecule to said TAT polypeptide and allowing binding therebetween. In a preferred embodiment, the cell is a cancerous cell of glial origin.

Other embodiments of the present invention are directed to the use of (a) a TAT polypeptide, (b) a nucleic acid encoding a TAT polypeptide or a vector or host cell comprising that nucleic acid, (c) an anti-TAT polypeptide antibody, (d) a TAT-binding oligopeptide, or (e) a TAT-binding small organic molecule in the preparation of a medicament useful for (i) the therapeutic treatment or diagnostic detection of a cancer or tumor, or (ii) the therapeutic treatment or prevention of a cell proliferative disorder, wherein the cancer, tumor or cell proliferative disorder may be, for example, a tumor of glial cell origin.

Another embodiment of the present invention is directed to a method for inhibiting the growth of a cancer cell, wherein the growth of said cancer cell is at least in part dependent upon the growth potentiating effect(s) of a TAT polypeptide (wherein the TAT polypeptide may be expressed either by the cancer cell itself or a cell that produces polypeptide(s) that have a growth potentiating effect on cancer cells), wherein the method comprises contacting the TAT polypeptide with an antibody, an oligopeptide or a small organic molecule that binds to the TAT polypeptide, thereby antagonizing the growth-potentiating activity of the TAT polypeptide and, in turn, inhibiting the growth of the cancer cell. Preferably the growth of the cancer cell is completely inhibited. Even more preferably, binding of the antibody, oligopeptide or small organic molecule to the TAT polypeptide induces the death of the cancer cell. Optionally, the antibody is a monoclonal antibody, antibody fragment, chimeric antibody, humanized antibody, or single-chain antibody. Antibodies, TAT binding oligopeptides and TAT binding organic molecules employed in the methods of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies and TAT binding oligopeptides employed in the methods of the present invention may optionally be produced in CHO cells or bacterial cells. In one embodiment, the cancer cell may be a cancer cell of glial origin.

Yet another embodiment of the present invention is directed to a method of therapeutically treating a tumor in a mammal, wherein the growth of said tumor is at least in part dependent upon the growth potentiating effect(s) of a TAT polypeptide, wherein the method comprises administering to the mammal a therapeutically effective amount of an antibody, an oligopeptide or a small organic molecule that binds to the TAT polypeptide, thereby antagonizing the growth potentiating activity of said TAT polypeptide and resulting in the effective therapeutic treatment of the tumor. In a preferred embodiment, the tumor is a tumor of glial cell origin. Optionally, the antibody is a monoclonal antibody, antibody fragment, chimeric antibody, humanized antibody, or single-chain antibody. Antibodies, TAT binding oligopeptides and TAT binding organic molecules employed in the methods of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies and oligopeptides employed in the methods of the present invention may optionally be produced in CHO cells or bacterial cells.

C. Further Additional Embodiments

Further additional embodiments of the present invention are shown in the following set of potential claims for this application.

1. Isolated nucleic acid having a nucleotide sequence that has at least 80% nucleic acid sequence identity to:

(a) a DNA molecule encoding the amino acid sequence shown in any one of FIGS. 97-190 (SEQ ID NOS:97-190);

(b) a DNA molecule encoding the amino acid sequence shown in any one of FIGS. 97-190 (SEQ ID NOS:97-190), lacking its associated signal peptide;

(c) a DNA molecule encoding an extracellular domain of the polypeptide shown in any one of FIGS. 97-190 (SEQ ID NOS:97-190), with its associated signal peptide;

(d) a DNA molecule encoding an extracellular domain of the polypeptide shown in any one of FIGS. 97-190 (SEQ ID NOS:97-190), lacking its associated signal peptide;

(e) the nucleotide sequence shown in any one of FIGS. 1-96 (SEQ ID NOS:1-96);

(f) the full-length coding region of the nucleotide sequence shown in any one of FIGS. 1-96 (SEQ ID NOS:1-96); or (g) the complement of (a), (b), (c), (d), (e) or (f).

2. Isolated nucleic acid having:

(a) a nucleotide sequence that encodes the amino acid sequence shown in any one of FIGS. 97-190 (SEQ ID NOS: 97-190);

(b) a nucleotide sequence that encodes the amino acid sequence shown in any one of FIGS. 97-190 (SEQ ID NOS: 97-190), lacking its associated signal peptide;

(c) a nucleotide sequence that encodes an extracellular domain of the polypeptide shown in any one of FIGS. 97-190 (SEQ ID NOS:97-190), with its associated signal peptide;

(d) a nucleotide sequence that encodes an extracellular domain of the polypeptide shown in any one of FIGS. 97-190 (SEQ ID NOS:97-190), lacking its associated signal peptide;

(e) the nucleotide sequence shown in any one of FIGS. 1-96 (SEQ ID NOS:1-96);

(f) the full-length coding region of the nucleotide sequence shown in any one of FIGS. 1-96 (SEQ ID NOS:1-96); or (g) the complement of (a), (b), (c), (d), (e) or (f).

3. Isolated nucleic acid that hybridizes to:

(a) a nucleic acid that encodes the amino acid sequence shown in any one of FIGS. 97-190 (SEQ ID NOS:97-190);

(b) a nucleic acid that encodes the amino acid sequence shown in any one of FIGS. 97-190 (SEQ ID NOS:97-190), lacking its associated signal peptide;

(c) a nucleic acid that encodes an extracellular domain of the polypeptide shown in any one of FIGS. 97-190 (SEQ ID NOS:97-190), with its associated signal peptide;

(d) a nucleic acid that encodes an extracellular domain of the polypeptide shown in any one of FIGS. 97-190 (SEQ ID NOS:97-190), lacking its associated signal peptide;

(e) the nucleotide sequence shown in any one of FIGS. 1-96 (SEQ ID NOS:1-96);

(f) the full-length coding region of the nucleotide sequence shown in any one of FIGS. 1-96 (SEQ ID NOS:1-96); or (g) the complement of (a), (b), (c), (d), (e) or (f).

4. The nucleic acid of Claim 3, wherein the hybridization occurs under stringent conditions.

5. The nucleic acid of Claim 3 which is at least about 5 nucleotides in length.

6. An expression vector comprising the nucleic acid of Claim 1, 2 or 3.

7. The expression vector of Claim 6, wherein said nucleic acid is operably linked to control sequences recognized by a host cell transformed with the vector.

8. A host cell comprising the expression vector of Claim 7.

9. The host cell of Claim 8 which is a CHO cell, an *E. coli* cell or a yeast cell.

10. A process for producing a polypeptide comprising culturing the host cell of Claim 8 under conditions suitable for expression of said polypeptide and recovering said polypeptide from the cell culture.

11. An isolated polypeptide having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96).

12. An isolated polypeptide having:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

13. A chimeric polypeptide comprising the polypeptide of Claim 11 or 12 fused to a heterologous polypeptide.

14. The chimeric polypeptide of Claim 13, wherein said heterologous polypeptide is an epitope tag sequence or an Fc region of an immunoglobulin.

15. An isolated antibody that binds to a polypeptide having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96).

16. An isolated antibody that binds to a polypeptide having:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

17. The antibody of Claim 15 or 16 which is a monoclonal antibody.

18. The antibody of Claim 15 or 16 which is an antibody fragment.

19. The antibody of Claim 15 or 16 which is a chimeric or a humanized antibody.

20. The antibody of Claim 15 or 16 which is conjugated to a growth inhibitory agent.

21. The antibody of Claim 15 or 16 which is conjugated to a cytotoxic agent.

22. The antibody of Claim 21, wherein the cytotoxic agent is selected from the group consisting of toxins, antibiotics, radioactive isotopes and nucleolytic enzymes.

23. The antibody of Claim 21, wherein the cytotoxic agent is a toxin.

24. The antibody of Claim 23, wherein the toxin is selected from the group consisting of maytansinoid and calicheamicin.

25. The antibody of Claim 23, wherein the toxin is a maytansinoid.

26. The antibody of Claim 15 or 16 which is produced in bacteria.

27. The antibody of Claim 15 or 16 which is produced in CHO cells.

28. The antibody of Claim 15 or 16 which induces death of a cell to which it binds.

29. The antibody of Claim 15 or 16 which is detectably labeled.

30. An isolated nucleic acid having a nucleotide sequence that encodes the antibody of Claim 15 or 16.

31. An expression vector comprising the nucleic acid of Claim 30 operably linked to control sequences recognized by a host cell transformed with the vector.

32. A host cell comprising the expression vector of Claim 31.

33. The host cell of Claim 32 which is a CHO cell, an *E. coli* cell or a yeast cell.

34. A process for producing an antibody comprising culturing the host cell of Claim 32 under conditions suitable for expression of said antibody and recovering said antibody from the cell culture.

35. An isolated oligopeptide that binds to a polypeptide having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96).

36. An isolated oligopeptide that binds to a polypeptide having:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

37. The oligopeptide of Claim 35 or 36 which is conjugated to a growth inhibitory agent.

38. The oligopeptide of Claim 35 or 36 which is conjugated to a cytotoxic agent.

39. The oligopeptide of Claim 38, wherein the cytotoxic agent is selected from the group consisting of toxins, antibiotics, radioactive isotopes and nucleolytic enzymes.

40. The oligopeptide of Claim 38, wherein the cytotoxic agent is a toxin.

41. The oligopeptide of Claim 40, wherein the toxin is selected from the group consisting of maytansinoid and calicheamicin.

42. The oligopeptide of Claim 40, wherein the toxin is a maytansinoid.

43. The oligopeptide of Claim 35 or 36 which induces death of a cell to which it binds.

44. The oligopeptide of Claim 35 or 36 which is detectably labeled.

45. A TAT binding organic molecule that binds to a polypeptide having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96).

46. The organic molecule of Claim 45 that binds to a polypeptide having:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

47. The organic molecule of Claim 45 or 46 which is conjugated to a growth inhibitory agent.

48. The organic molecule of Claim 45 or 46 which is conjugated to a cytotoxic agent.

49. The organic molecule of Claim 48, wherein the cytotoxic agent is selected from the group consisting of toxins, antibiotics, radioactive isotopes and nucleolytic enzymes.

50. The organic molecule of Claim 48, wherein the cytotoxic agent is a toxin.

51. The organic molecule of Claim 50, wherein the toxin is selected from the group consisting of maytansinoid and calicheamicin.

52. The organic molecule of Claim 50, wherein the toxin is a maytansinoid.

53. The organic molecule of Claim 45 or 46 which induces death of a cell to which it binds.

54. The organic molecule of Claim 45 or 46 which is detectably labeled.

55. A composition of matter comprising:

(a) the polypeptide of Claim 11;

(b) the polypeptide of Claim 12;

(c) the chimeric polypeptide of Claim 13;

(d) the antibody of Claim 15;

(e) the antibody of Claim 16;

(f) the oligopeptide of Claim 35;

(g) the oligopeptide of Claim 36;

(h) the TAT binding organic molecule of Claim 45; or (i) the TAT binding organic molecule of Claim 46; in combination with a carrier.

56. The composition of matter of Claim 55, wherein said carrier is a pharmaceutically acceptable carrier.

57. An article of manufacture comprising:

(a) a container; and (b) the composition of matter of Claim 55 contained within said container.

58. The article of manufacture of Claim 57 further comprising a label affixed to said container, or a package insert included with said container, referring to the use of said composition of matter for the therapeutic treatment of or the diagnostic detection of a cancer.

59. A method of inhibiting the growth of a cell that expresses a protein having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96), said method comprising contacting said cell with an antibody, oligopeptide or organic molecule that binds to said protein, the binding of said antibody, oligopeptide or organic molecule to said protein thereby causing an inhibition of growth of said cell.

60. The method of Claim 59, wherein said antibody is a monoclonal antibody.

61. The method of Claim 59, wherein said antibody is an antibody fragment.

62. The method of Claim 59, wherein said antibody is a chimeric or a humanized antibody.

63. The method of Claim 59, wherein said antibody, oligopeptide or organic molecule is conjugated to a growth inhibitory agent.

64. The method of Claim 59, wherein said antibody, oligopeptide or organic molecule is conjugated to a cytotoxic agent.

65. The method of Claim 64, wherein said cytotoxic agent is selected from the group consisting of toxins, antibiotics, radioactive isotopes and nucleolytic enzymes.

66. The method of Claim 64, wherein the cytotoxic agent is a toxin.

67. The method of Claim 66, wherein the toxin is selected from the group consisting of maytansinoid and calicheamicin.

68. The method of Claim 66, wherein the toxin is a maytansinoid.

69. The method of Claim 59, wherein said antibody is produced in bacteria.

70. The method of Claim 59, wherein said antibody is produced in CHO cells.

71. The method of Claim 59, wherein said cell is a cancer cell.

72. The method of Claim 71, wherein said cancer cell is further exposed to radiation treatment or a chemotherapeutic agent.

73. The method of Claim 71, wherein said cancer cell is glial cancer cell.

74. The method of Claim 71, wherein said protein is more abundantly expressed by said cancer cell as compared to a normal cell of the same tissue origin.

75. The method of Claim 59 which causes the death of said cell.

76. The method of Claim 59, wherein said protein has:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

77. A method of therapeutically treating a mammal having a cancerous tumor comprising cells that express a protein having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96), said method comprising administering to said mammal a therapeutically effective amount of an antibody, oligopeptide or organic molecule that binds to said protein, thereby effectively treating said mammal.

78. The method of Claim 77, wherein said antibody is a monoclonal antibody.

79. The method of Claim 77, wherein said antibody is an antibody fragment.

80. The method of Claim 77, wherein said antibody is a chimeric or a humanized antibody.

81. The method of Claim 77, wherein said antibody, oligopeptide or organic molecule is conjugated to a growth inhibitory agent.

82. The method of Claim 77, wherein said antibody, oligopeptide or organic molecule is conjugated to a cytotoxic agent.

83. The method of Claim 82, wherein said cytotoxic agent is selected from the group consisting of toxins, antibiotics, radioactive isotopes and nucleolytic enzymes.

84. The method of Claim 82, wherein the cytotoxic agent is a toxin.

85. The method of Claim 84, wherein the toxin is selected from the group consisting of maytansinoid and calicheamicin.

86. The method of Claim 84, wherein the toxin is a maytansinoid.

87. The method of Claim 77, wherein said antibody is produced in bacteria.

88. The method of Claim 77, wherein said antibody is produced in CHO cells.

89. The method of Claim 77, wherein said tumor is further exposed to radiation treatment or a chemotherapeutic agent.

90. The method of Claim 77, wherein said tumor is a glial cell-derived tumor.

91. The method of Claim 77, wherein said protein is more abundantly expressed by the cancerous cells of said tumor as compared to a normal cell of the same tissue origin.

92. The method of Claim 77, wherein said protein has:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

93. A method of determining the presence of a protein in a sample suspected of containing said protein, wherein said protein has at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96), said method comprising exposing said sample to an antibody, oligopeptide or organic molecule that binds to said protein and determining binding of said antibody, oligopeptide or organic molecule to said protein in said sample, wherein binding of the antibody, oligopeptide or organic molecule to said protein is indicative of the presence of said protein in said sample.

94. The method of Claim 93, wherein said sample comprises a cell suspected of expressing said protein.

95. The method of Claim 94, wherein said cell is a cancer cell.

96. The method of Claim 93, wherein said antibody, oligopeptide or organic molecule is detectably labeled.

97. The method of Claim 93, wherein said protein has:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or, (f) an amino acid sequence encoded by the full-length coding region of the nucleotide sequence shown in any one of FIGS. 1-96 (SEQ ID NOS:1-96).

98. A method of diagnosing the presence of a tumor in a mammal, said method comprising determining the level of expression of a gene encoding a protein having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96), in a test sample of tissue cells obtained from said mammal and in a control sample of known normal cells of the same tissue origin, wherein a higher level of expression of said protein in the test sample, as compared to the control sample, is indicative of the presence of tumor in the mammal from which the test sample was obtained.

99. The method of Claim 98, wherein the step of determining the level of expression of a gene encoding said protein comprises employing an oligonucleotide in an in situ hybridization or RT-PCR analysis.

100. The method of Claim 98, wherein the step determining the level of expression of a gene encoding said protein comprises employing an antibody in an immunohistochemistry or Western blot analysis.

101. The method of Claim 98, wherein said protein has:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

102. A method of diagnosing the presence of a tumor in a mammal, said method comprising contacting a test sample of tissue cells obtained from said mammal with an antibody, oligopeptide or organic molecule that binds to a protein having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96), and detecting the formation of a complex between said antibody, oligopeptide or organic molecule and said protein in the test sample, wherein the formation of a complex is indicative of the presence of a tumor in said mammal.

103. The method of Claim 102, wherein said antibody, oligopeptide or organic molecule is detectably labeled.

104. The method of Claim 102, wherein said test sample of tissue cells is obtained from an individual suspected of having a cancerous tumor.

105. The method of Claim 102, wherein said protein has:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

106. A method for treating or preventing a cell proliferative disorder associated with increased expression or activity of a protein having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96), said method comprising administering to a subject in need of such treatment an effective amount of an antagonist of said protein, thereby effectively treating or preventing said cell proliferative disorder.

107. The method of Claim 106, wherein said cell proliferative disorder is cancer.

108. The method of Claim 106, wherein said antagonist is an anti-TAT polypeptide antibody, TAT binding oligopeptide, TAT binding organic molecule or antisense oligonucleotide.

109. A method of binding an antibody, oligopeptide or organic molecule to a cell that expresses a protein having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96), said method comprising contacting said cell with an antibody, oligopeptide or organic molecule that binds to said protein and allowing the binding of the antibody, oligopeptide or organic molecule to said protein to occur, thereby binding said antibody, oligopeptide or organic molecule to said cell.

110. The method of Claim 109, wherein said antibody is a monoclonal antibody.

111. The method of Claim 109, wherein said antibody is an antibody fragment.

112. The method of Claim 109, wherein said antibody is a chimeric or a humanized antibody.

113. The method of Claim 109, wherein said antibody, oligopeptide or organic molecule is conjugated to a growth inhibitory agent.

114. The method of Claim 109, wherein said antibody, oligopeptide or organic molecule is conjugated to a cytotoxic agent.

115. The method of Claim 114, wherein said cytotoxic agent is selected from the group consisting of toxins, antibiotics, radioactive isotopes and nucleolytic enzymes.

116. The method of Claim 114, wherein the cytotoxic agent is a toxin.

117. The method of Claim 116, wherein the toxin is selected from the group consisting of maytansinoid and calicheamicin.

118. The method of Claim 116, wherein the toxin is a maytansinoid.

119. The method of Claim 109, wherein said antibody is produced in bacteria.

120. The method of Claim 109, wherein said antibody is produced in CHO cells.

121. The method of Claim 109, wherein said cell is a cancer cell.

122. The method of Claim 121, wherein said cancer cell is further exposed to radiation treatment or a chemotherapeutic agent.

123. The method of Claim 121, wherein said cancer cell is glial cancer cell.

124. The method of Claim 123, wherein said protein is more abundantly expressed by said cancer cell as compared to a normal cell of the same tissue origin.

125. The method of Claim 109 which causes the death of said cell.

126. Use of a nucleic acid as claimed in any of Claims 1 to 5 or 30 in the preparation of a medicament for the therapeutic treatment or diagnostic detection of a cancer.

127. Use of a nucleic acid as claimed in any of Claims 1 to 5 or 30 in the preparation of a medicament for treating a tumor.

128. Use of a nucleic acid as claimed in any of Claims 1 to 5 or 30 in the preparation of a medicament for treatment or prevention of a cell proliferative disorder.

129. Use of an expression vector as claimed in any of Claims 6, 7 or 31 in the preparation of a medicament for the therapeutic treatment or diagnostic detection of a cancer.

130. Use of an expression vector as claimed in any of Claims 6, 7 or 31 in the preparation of medicament for treating a tumor.

131. Use of an expression vector as claimed in any of Claims 6, 7 or 31 in the preparation of a medicament for treatment or prevention of a cell proliferative disorder.

132. Use of a host cell as claimed in any of Claims 8, 9, 32, or 33 in the preparation of a medicament for the therapeutic treatment or diagnostic detection of a cancer.

133. Use of a host cell as claimed in any of Claims 8, 9, 32 or 33 in the preparation of a medicament for treating a tumor.

134. Use of a host cell as claimed in any of Claims 8, 9, 32 or 33 in the preparation of a medicament for treatment or prevention of a cell proliferative disorder.

135. Use of a polypeptide as claimed in any of Claims 11 to 14 in the preparation of a medicament for the therapeutic treatment or diagnostic detection of a cancer.

136. Use of a polypeptide as claimed in any of Claims 11 to 14 in the preparation of a medicament for treating a tumor.

137. Use of a polypeptide as claimed in any of Claims 11 to 14 in the preparation of a medicament for treatment or prevention of a cell proliferative disorder.

138. Use of an antibody as claimed in any of Claims 15 to 29 in the preparation of a medicament for the therapeutic treatment or diagnostic detection of a cancer.

139. Use of an antibody as claimed in any of Claims 15 to 29 in the preparation of a medicament for treating a tumor.

140. Use of an antibody as claimed in any of Claims 15 to 29 in the preparation of a medicament for treatment or prevention of a cell proliferative disorder.

141. Use of an oligopeptide as claimed in any of Claims 35 to 44 in the preparation of a medicament for the therapeutic treatment or diagnostic detection of a cancer.

142. Use of an oligopeptide as claimed in any of Claims 35 to 44 in the preparation of a medicament for treating a tumor.

143. Use of an oligopeptide as claimed in any of Claims 35 to 44 in the preparation of a medicament for treatment or prevention of a cell proliferative disorder.

144. Use of a TAT binding organic molecule as claimed in any of Claims 45 to 54 in the preparation of a medicament for the therapeutic treatment or diagnostic detection of a cancer.

145. Use of a TAT binding organic molecule as claimed in any of Claims 45 to 54 in the preparation of a medicament for treating a tumor.

146. Use of a TAT binding organic molecule as claimed in any of Claims 45 to 54 in the preparation of a medicament for treatment or prevention of a cell proliferative disorder.

147. Use of a composition of matter as claimed in any of Claims 55 or 56 in the preparation of a medicament for the therapeutic treatment or diagnostic detection of a cancer.

148. Use of a composition of matter as claimed in any of Claims 55 or 56 in the preparation of a medicament for treating a tumor.

149. Use of a composition of matter as claimed in any of Claims 55 or 56 in the preparation of a medicament for treatment or prevention of a cell proliferative disorder.

150. Use of an article of manufacture as claimed in any of Claims 57 or 58 in the preparation of a medicament for the therapeutic treatment or diagnostic detection of a cancer.

151. Use of an article of manufacture as claimed in any of Claims 57 or 58 in the preparation of a medicament for treating a tumor.

152; Use of an article of manufacture as claimed in any of Claims 57 or 58 in the preparation of a medicament for treatment or prevention of a cell proliferative disorder.

153. A method for inhibiting the growth of a cell, wherein the growth of said cell is at least in part dependent upon a growth potentiating effect of a protein having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96), said method comprising contacting said protein with an antibody, oligopeptide or organic molecule that binds to said protein, there by inhibiting the growth of said cell.

154. The method of Claim 153, wherein said cell is a cancer cell.

155. The method of Claim 153, wherein said protein is expressed by said cell.

156. The method of Claim 153, wherein the binding of said antibody, oligopeptide or organic molecule to said protein antagonizes a cell growth-potentiating activity of said protein.

157. The method of Claim 153, wherein the binding of said antibody, oligopeptide or organic molecule to said protein induces the death of said cell.

158. The method of Claim 153, wherein said antibody is a monoclonal antibody.

159. The method of Claim 153, wherein said antibody is an antibody fragment.

160. The method of Claim 153, wherein said antibody is a chimeric or a humanized antibody.

161. The method of Claim 153, wherein said antibody, oligopeptide or organic molecule is conjugated to a growth inhibitory agent.

162. The method of Claim 153, wherein said antibody, oligopeptide or organic molecule is conjugated to a cytotoxic agent.

163. The method of Claim 162, wherein said cytotoxic agent is selected from the group consisting of toxins, antibiotics, radioactive isotopes and nucleolytic enzymes.

164. The method of Claim 162, wherein the cytotoxic agent is a toxin.

165. The method of Claim 164, wherein the toxin is selected from the group consisting of maytansinoid and calicheamicin.

166. The method of Claim 164, wherein the toxin is a maytansinoid.

167. The method of Claim 153, wherein said antibody is produced in bacteria.

168. The method of Claim 153, wherein said antibody is produced in CHO cells.

169. The method of Claim 153, wherein said protein has:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

170. A method of therapeutically treating a tumor in a mammal, wherein the growth of said tumor is at least in part dependent upon a growth potentiating effect of a protein having at least 80% amino acid sequence identity to:

(a) the polypeptide shown in any one of FIGS. 97-190 (SEQ ID NOS:97-190);

(b) the polypeptide shown in any one of FIGS. 97-190 (SEQ ID NOS:97-190), lacking its associated signal peptide;

(c) an extracellular domain of the polypeptide shown in any one of FIGS. 97-190 (SEQ ID NOS:97-190), with its associated signal peptide;

(d) an extracellular domain of the polypeptide shown in any one of FIGS. 97-190 (SEQ ID NOS:97-190), lacking its associated signal peptide;

(e) a polypeptide encoded by the nucleotide sequence shown in any one of FIGS. 1-96 (SEQ ID NOS:1-96); or (f) a polypeptide encoded by the full-length coding region of the nucleotide sequence shown in any one of FIGS. 1-96 (SEQ ID NOS:1-96), said method comprising contacting said protein with an antibody, oligopeptide or organic molecule that binds to said protein, thereby effectively treating said tumor.

171. The method of Claim 170, wherein said protein is expressed by cells of said tumor.

172. The method of Claim 170, wherein the binding of said antibody, oligopeptide or organic molecule to said protein antagonizes a cell growth-potentiating activity of said protein.

173. The method of Claim 170, wherein said antibody is a monoclonal antibody.

174. The method of Claim 170, wherein said antibody is an antibody fragment.

175. The method of Claim 170, wherein said antibody is a chimeric or a humanized antibody.

176. The method of Claim 170, wherein said antibody, oligopeptide or organic molecule is conjugated to a growth inhibitory agent.

177. The method of Claim 170, wherein said antibody, oligopeptide or organic molecule is conjugated to a cytotoxic agent.

178. The method of Claim 177, wherein said cytotoxic agent is selected from the group consisting of toxins, antibiotics, radioactive isotopes and nucleolytic enzymes.

179. The method of Claim 177, wherein the cytotoxic agent is a toxin.

180. The method of Claim 179, wherein the toxin is selected from the group consisting of maytansinoid and calicheamicin.

181. The method of Claim 179, wherein the toxin is a maytansinoid.

182. The method of Claim 170, wherein said antibody is produced in bacteria.

183. The method of Claim 170, wherein said antibody is produced in CHO cells.

184. The method of Claim 170, wherein said protein has:

(a) the amino acid sequence shown in any one of FIGS. 97-190 (SEQ ID NOS:97-190);

(b) the amino acid sequence shown in any one of FIGS. 97-190 (SEQ ID NOS:97-190), lacking its associated signal peptide sequence;

(c) an amino acid sequence of an extracellular domain of the polypeptide shown in any one of FIGS. 97-190 (SEQ ID NOS:97-190), with its associated signal peptide sequence;

(d) an amino acid sequence of an extracellular domain of the polypeptide shown in any one of FIGS. 97-190 (SEQ ID NOS:97-190), lacking its associated signal peptide sequence;

(e) an amino acid sequence encoded by the nucleotide sequence shown in any one of FIGS. 1-96 (SEQ ID NOS:1-96); or (f) an amino acid sequence encoded by the full-length coding region of the nucleotide sequence shown in any one of FIGS. 1-96 (SEQ ID NOS:1-96).

185. A method of inhibiting the growth of a tumor cell of glial origin comprising contacting said cell with a composition comprising a first binding agent and a second binding agent, wherein said first binding agent is a first antibody, first oligopeptide or first organic molecule that binds to a type A glial tumor antigen and wherein said second binding agent is a second antibody, second oligopeptide or second organic molecule that binds to a type B glial tumor antigen, the binding of said first antibody, first oligopeptide or first organic molecule to said type A glial tumor antigen and the binding of said second antibody, second oligopeptide or second organic molecule to said type B glial tumor antigen thereby causing an inhibition of growth of said cell.

186. The method of Claim 185, wherein said first or second antibody is a monoclonal antibody.

187. The method of Claim 185, wherein said first or second antibody is an antibody fragment.

188. The method of Claim 185, wherein said first or second antibody is a chimeric or a humanized antibody.

189. The method of Claim 185, wherein said first or second antibody, first or second oligopeptide or first or second organic molecule is conjugated to a growth inhibitory agent.

190. The method of Claim 185, wherein said first or second antibody, first or second oligopeptide or first or second organic molecule is conjugated to a cytotoxic agent.

191 The method of Claim 190, wherein said cytotoxic agent is selected from the group consisting of toxins, antibiotics, radioactive isotopes and nucleolytic enzymes.

192. The method of Claim 190, wherein the cytotoxic agent is a toxin.

193. The method of Claim 192, wherein the toxin is selected from the group consisting of maytansinoid and calicheamicin.

194. The method of Claim 192, wherein the toxin is a maytansinoid.

195. The method of Claim 185, wherein said first or second antibody is produced in bacteria.

196. The method of Claim 185, wherein said first or second antibody is produced in CHO cells.

197. The method of Claim 185, wherein said tumor cell of glial origin is further exposed to radiation treatment or a chemotherapeutic agent.

198. The method of Claim 185 which causes the death of said tumor cell.

199. The method of Claim 185, wherein said first binding agent and said second binding agent are linked.

200. The method of Claim 199, wherein said first binding agent and said second binding agent are contained within a bispecific antibody.

201. The method of Claim 185, further comprising contacting said tumor cell with a third binding agent which is a third antibody, third oligopeptide or third organic molecule that binds to a type C glial tumor antigen.

202. A method of therapeutically treating a mammal having a tumor of glial origin comprising cells that express a type A glial tumor antigen, said method comprising contacting said cells with a composition comprising a first binding agent and a second binding agent, wherein said first binding agent is a first antibody, first oligopeptide or first organic molecule that binds to a type A glial tumor antigen and wherein said second binding agent is a second antibody, second oligopeptide or second organic molecule that binds to a type B glial tumor antigen, the binding of said first antibody, first oligopeptide or first organic molecule to said type A glial tumor antigen and the binding of said second antibody, second oligopeptide or second organic molecule to said type B glial tumor antigen thereby effectively treating said mammal.

203. The method of Claim 202, wherein said first or second antibody is a monoclonal antibody.

204. The method of Claim 202, wherein said first or second antibody is an antibody fragment.

205. The method of Claim 202, wherein said first or second antibody is a chimeric or a humanized antibody.

206. The method of Claim 202, wherein said first or second antibody, first or second oligopeptide or first or second organic molecule is conjugated to a growth inhibitory agent.

207. The method of Claim 202, wherein said first or second antibody, first or second oligopeptide or first or second organic molecule is conjugated to a cytotoxic agent.

208 The method of Claim 207, wherein said cytotoxic agent is selected from the group consisting of toxins, antibiotics, radioactive isotopes and nucleolytic enzymes.

209. The method of Claim 207, wherein the cytotoxic agent is a toxin.

210. The method of Claim 209, wherein the toxin is selected from the group consisting of maytansinoid and calicheamicin.

211. The method of Claim 209, wherein the toxin is a maytansinoid.

212. The method of Claim 202, wherein said first or second antibody is produced in bacteria.

213. The method of Claim 202, wherein said first or second antibody is produced in CHO cells.

214. The method of Claim 202, wherein said cells are further exposed to radiation treatment or a chemotherapeutic agent.

215. The method of Claim 202 which causes the death of said cells.

216. The method of Claim 202, wherein said first binding agent and said second binding agent are linked.

217. The method of Claim 216, wherein said first binding agent and said second binding agent are contained within a bispecific antibody.

218. The method of Claim 202, further comprising contacting said cells with a third binding agent which is a third antibody, third oligopeptide or third organic molecule that binds to a type C glial tumor antigen.

219. A method of therapeutically treating a mammal having a tumor of glial origin comprising cells that express a type B glial tumor antigen, said method comprising contacting said cells with a composition comprising a first binding agent and a second binding agent, wherein said first binding agent is a first antibody, first oligopeptide or first organic molecule that binds to a type A glial tumor antigen and wherein said second binding agent is a second antibody, second oligopeptide or second organic molecule that binds to a type B glial tumor antigen, the binding of said first antibody, first oligopeptide or first organic molecule to said type A glial tumor antigen and the binding of said second antibody, second oligopeptide or second organic molecule to said type B glial tumor antigen thereby effectively treating said mammal.

220. The method of Claim 219, wherein said first or second antibody is a monoclonal antibody.

221. The method of Claim 219, wherein said first or second antibody is an antibody fragment.

222. The method of Claim 219, wherein said first or second antibody is a chimeric or a humanized antibody.

223. The method of Claim 219, wherein said first or second antibody, first or second oligopeptide or first or second organic molecule is conjugated to a growth inhibitory agent.

224. The method of Claim 219, wherein said first or second antibody, first or second oligopeptide or first or second organic molecule is conjugated to a cytotoxic agent.

225 The method of Claim 224, wherein said cytotoxic agent is selected from the group consisting of toxins, antibiotics, radioactive isotopes and nucleolytic enzymes.

226. The method of Claim 224, wherein the cytotoxic agent is a toxin.

227. The method of Claim 226, wherein the toxin is selected from the group consisting of maytansinoid and calicheamicin.

228. The method of Claim 226, wherein the toxin is a maytansinoid.

229. The method of Claim 219, wherein said first or second antibody is produced in bacteria.

230. The method of Claim 219, wherein said first or second antibody is produced in CHO cells.

231. The method of Claim 219, wherein said cells are further exposed to radiation treatment or a chemotherapeutic agent.

232. The method of Claim 219 which causes the death of said cells.

233. The method of Claim 219, wherein said first binding agent and said second binding agent are linked.

234. The method of Claim 233, wherein said first binding agent and said second binding agent are contained within a bispecific antibody.

235. The method of Claim 219, further comprising contacting said cells with a third binding agent which is a third antibody, third oligopeptide or third organic molecule that binds to a type C glial tumor antigen.

236. A method of determining the presence of a type A glial tumor in a mammal, said method comprising:

(a) obtaining a test tissue sample from said mammal, wherein said test tissue sample is suspected of being a glial cell-derived tumor; and (b) detecting at least a 5 fold increase in the amount of at least 3 different type A glial tumor antigens in said test sample as compared to normal adult brain, wherein said detection is indicative of said test tissue sample being a type A glial tumor.

237. The method according to Claim 236, wherein said increased expression of said type A glial tumor antigens is at the mRNA level.

238. The method according to Claim 236, wherein said increased expression of said type A glial tumor antigens is at the protein level.

239. A method of determining the presence of a type B glial tumor in a mammal, said method comprising:

(a) obtaining a test tissue sample from said mammal, wherein said test tissue sample is suspected of being a glial cell-derived tumor; and (b) detecting (i) at least a 10 fold increase in the amount of at least 3 different type B glial tumor antigens in said test sample as compared to normal adult brain and (ii) that no group of three type A antigens are expressed at least 5-fold above the level of expression of that group in normal adult brain, wherein said detection is indicative of said test tissue sample being a type B glial tumor.

240. The method according to Claim 239, wherein said increased expression of said type B glial tumor antigens is at the mRNA level.

241. The method according to Claim 239, wherein said increased expression of said type B glial tumor antigens is at the protein level.

Yet further embodiments of the present invention will be evident to the skilled artisan upon a reading of the present specification.

BRIEF DESCRIPTION OF THE DRAWINGS

FIG. 1 shows a nucleotide sequence (SEQ ID NO:1) of a TAT152 cDNA, wherein SEQ ID NO:1 is a clone designated herein as "DNA246435".

FIG. 2 shows a nucleotide sequence (SEQ ID NO:2) of a TAT285 cDNA, wherein SEQ ID NO:2 is a clone designated herein as "DNA297393".

FIG. 3 shows a nucleotide sequence (SEQ ID NO:3) of a TAT214 cDNA, wherein SEQ ID NO:3 is a clone designated herein as "DNA266920".

FIG. 4 shows a nucleotide sequence (SEQ ID NO:4) of a TAT422 cDNA, wherein SEQ ID NO:4 is a clone designated herein as "DNA35916".

FIG. 5 shows a nucleotide sequence (SEQ ID NO:5) of a TAT385 cDNA, wherein SEQ ID NO:5 is a clone designated herein as "DNA92958".

FIG. 6 shows a nucleotide sequence (SEQ ID NO:6) of a TAT164 cDNA, wherein SEQ ID NO:6 is a clone designated herein as "DNA226094".

FIG. 7 shows a nucleotide sequence (SEQ ID NO:7) of a TAT423 cDNA, wherein SEQ ID NO:7 is a clone designated herein as "DNA225643".

FIG. 8 shows a nucleotide sequence (SEQ ID NO:8) of a TAT424 cDNA, wherein SEQ ID NO:8 is a clone designated herein as "DNA225649".

FIG. 9 shows a nucleotide sequence (SEQ ID NO:9) of a TAT425 cDNA, wherein SEQ ID NO:9 is a clone designated herein as "DNA226522".

FIG. 10 shows a nucleotide sequence (SEQ ID NO:10) of a TAT426 cDNA, wherein SEQ ID NO:10 is a clone designated herein as "DNA225758".

FIG. 11 shows a nucleotide sequence (SEQ ID NO:11) of a TAT427 cDNA, wherein SEQ ID NO:11 is a clone designated herein as "DNA256886".

FIG. 12 shows a nucleotide sequence (SEQ ID NO:12) of a TAT428 cDNA, wherein SEQ ID NO:12 is a clone designated herein as "DNA340337".

FIG. 13 shows a nucleotide sequence (SEQ ID NO:13) of a TAT429 cDNA, wherein SEQ ID NO:13 is a clone designated herein as "DNA254942".

FIG. 14 shows a nucleotide sequence (SEQ ID NO:14) of a TAT430 cDNA, wherein SEQ ID NO:14 is a clone designated herein as "DNA255505".

FIG. 15 shows a nucleotide sequence (SEQ ID NO:15) of a TAT431 cDNA, wherein SEQ ID NO:15 is a clone designated herein as "DNA272284".

FIG. 16 shows a nucleotide sequence (SEQ ID NO:16) of a TAT432 cDNA, wherein SEQ ID NO:16 is a clone designated herein as "DNA273088".

FIG. 17 shows a nucleotide sequence (SEQ ID NO:17) of a TAT433 cDNA, wherein SEQ ID NO:17 is a clone designated herein as "DNA225556".

FIG. 18 shows a nucleotide sequence (SEQ ID NO:18) of a TAT434 cDNA, wherein SEQ ID NO:18 is a clone designated herein as "DNA226037".

FIG. 19 shows a nucleotide sequence (SEQ ID NO:19) of a TAT391 cDNA, wherein SEQ ID NO:19 is a clone designated herein as "DNA331171".

FIG. 20 shows a nucleotide sequence (SEQ ID NO:20) of a TAT435 cDNA, wherein SEQ ID NO:20 is a clone designated herein as "DNA334625".

FIG. 21 shows a nucleotide sequence (SEQ ID NO:21) of a TAT436 cDNA, wherein SEQ ID NO:21 is a clone designated herein as "DNA255915".

FIG. 22 shows a nucleotide sequence (SEQ ID NO:22) of a TAT437 cDNA, wherein SEQ ID NO:22 is a clone designated herein as "DNA271568".

FIG. 23 shows a nucleotide sequence (SEQ ID NO:23) of a TAT438 cDNA, wherein SEQ ID NO:23 is a clone designated herein as "DNA330250".

FIG. 24 shows a nucleotide sequence (SEQ ID NO:24) of a TAT439 cDNA, wherein SEQ ID NO:24 is a clone designated herein as "DNA226627".

FIG. 25 shows a nucleotide sequence (SEQ ID NO:25) of a TAT440 cDNA, wherein SEQ ID NO:25 is a clone designated herein as "DNA336053".

FIG. 26 shows a nucleotide sequence (SEQ ID NO:26) of a TAT441 cDNA, wherein SEQ ID NO:26 is a clone designated herein as "DNA226375".

FIG. 27 shows a nucleotide sequence (SEQ ID NO:27) of a TAT442 cDNA, wherein SEQ ID NO:27 is a clone designated herein as "DNA275290".

FIG. 28 shows a nucleotide sequence (SEQ ID NO:28) of a TAT443 cDNA, wherein SEQ ID NO:28 is a clone designated herein as "DNA336054".

FIG. 29 shows a nucleotide sequence (SEQ ID NO:29) of a TAT351 cDNA, wherein SEQ ID NO:29 is a clone designated herein as "DNA273438".

FIG. 30 shows a nucleotide sequence (SEQ ID NO:30) of a TAT444 cDNA, wherein SEQ ID NO:30 is a clone designated herein as "DNA150906".

FIG. 31 shows a nucleotide sequence (SEQ ID NO:31) of a TAT227 cDNA, wherein SEQ ID NO:31 is a clone designated herein as "DNA266307".

FIG. 32 shows a nucleotide sequence (SEQ ID NO:32) of a TAT445 cDNA, wherein SEQ ID NO:32 is a clone designated herein as "DNA98541".

FIG. 33 shows a nucleotide sequence (SEQ ID NO:33) of a TAT446 cDNA, wherein SEQ ID NO:33 is a clone designated herein as "DNA227020".

FIG. 34 shows a nucleotide sequence (SEQ ID NO:34) of a TAT447 cDNA, wherein SEQ ID NO:34 is a clone designated herein as "DNA92995".

FIG. 35 shows a nucleotide sequence (SEQ ID NO:35) of a TAT448 cDNA, wherein SEQ ID NO:35 is a clone designated herein as "DNA225952".

FIG. 36 shows a nucleotide sequence (SEQ ID NO:36) of a TAT449 cDNA, wherein SEQ ID NO:36 is a clone designated herein as "DNA225829".

FIG. 37 shows a nucleotide sequence (SEQ ID NO:37) of a TAT450 cDNA, wherein SEQ ID NO:37 is a clone designated herein as "DNA226129".

FIG. 38 shows a nucleotide sequence (SEQ ID NO:38) of a TAT451 cDNA, wherein SEQ ID NO:38 is a clone designated herein as "DNA226061".

FIG. 39 shows a nucleotide sequence (SEQ ID NO:39) of a TAT452 cDNA, wherein SEQ ID NO:39 is a clone designated herein as "DNA96911".

FIG. 40 shows a nucleotide sequence (SEQ ID NO:40) of a TAT453 cDNA, wherein SEQ ID NO:40 is a clone designated herein as "DNA226121".

FIG. 41 shows a nucleotide sequence (SEQ ID NO:41) of a TAT454 cDNA, wherein SEQ ID NO:41 is a clone designated herein as "DNA226651".

FIG. 42 shows a nucleotide sequence (SEQ ID NO:42) of a TAT455 cDNA, wherein SEQ ID NO:42 is a clone designated herein as "DNA226968".

FIG. 43 shows a nucleotide sequence (SEQ ID NO:43) of a TAT456 cDNA, wherein SEQ ID NO:43 is a clone designated herein as "DNA226843".

FIG. 44 shows a nucleotide sequence (SEQ ID NO:44) of a TAT457 cDNA, wherein SEQ ID NO:44 is a clone designated herein as "DNA242495".

FIG. 45 shows a nucleotide sequence (SEQ ID NO:45) of a TAT458 cDNA, wherein SEQ ID NO:45 is a clone designated herein as "DNA92981".

FIG. 46 shows a nucleotide sequence (SEQ ID NO:46) of a TAT459 cDNA, wherein SEQ ID NO:46 is a clone designated herein as "DNA208684".

FIG. 47 shows a nucleotide sequence (SEQ ID NO:47) of a TAT171 cDNA, wherein SEQ ID NO:47 is a clone designated herein as "DNA53971".

FIG. 48 shows a nucleotide sequence (SEQ ID NO:48) of a TAT460 cDNA, wherein SEQ ID NO:48 is a clone designated herein as "DNA226031".

FIG. 49 shows a nucleotide sequence (SEQ ID NO:49) of a TAT461 cDNA, wherein SEQ ID NO:49 is a clone designated herein as "DNA82314".

FIG. 50 shows a nucleotide sequence (SEQ ID NO:50) of a TAT462 cDNA, wherein SEQ ID NO:50 is a clone designated herein as "DNA226139".

FIG. 51 shows a nucleotide sequence (SEQ ID NO:51) of a TAT463 cDNA, wherein SEQ ID NO:51 is a clone designated herein as "DNA226006".

FIG. 52 shows a nucleotide sequence (SEQ ID NO:52) of a TAT464 cDNA, wherein SEQ ID NO:52 is a clone designated herein as "DNA88323".

FIG. 53 shows a nucleotide sequence (SEQ ID NO:53) of a TAT465 cDNA, wherein SEQ ID NO:53 is a clone designated herein as "DNA304673".

FIG. 54 shows a nucleotide sequence (SEQ ID NO:54) of a TAT466 cDNA, wherein SEQ ID NO:54 is a clone designated herein as "DNA208684".

FIG. 55 shows a nucleotide sequence (SEQ ID NO:55) of a TAT467 cDNA, wherein SEQ ID NO:55 is a clone designated herein as "DNA188396".

FIG. 56 shows a nucleotide sequence (SEQ ID NO:56) of a TAT468 cDNA, wherein SEQ ID NO:56 is a clone designated herein as "DNA33447".

FIG. 57 shows a nucleotide sequence (SEQ ID NO:57) of a TAT469 cDNA, wherein SEQ ID NO:57 is a clone designated herein as "DNA225520".

FIG. 58 shows a nucleotide sequence (SEQ ID NO:58) of a TAT274 cDNA, wherein SEQ ID NO:58 is a clone designated herein as "DNA182764".

FIG. 59 shows a nucleotide sequence (SEQ ID NO:59) of a TAT470 cDNA, wherein SEQ ID NO:59 is a clone designated herein as "DNA226874".

FIG. 60 shows a nucleotide sequence (SEQ ID NO:60) of a TAT471 cDNA, wherein SEQ ID NO:60 is a clone designated herein as "DNA227470".

FIG. 61 shows a nucleotide sequence (SEQ ID NO:61) of a TAT262 cDNA, wherein SEQ ID NO:61 is a clone designated herein as "DNA88126".

FIG. 62 shows a nucleotide sequence (SEQ ID NO:62) of a TAT263 cDNA, wherein SEQ ID NO:62 is a clone designated herein as "DNA103464".

FIG. 63 shows a nucleotide sequence (SEQ ID NO:63) of a TAT472 cDNA, wherein SEQ ID NO:63 is a clone designated herein as "DNA88123".

FIG. 64 shows a nucleotide sequence (SEQ ID NO:64) of a TAT473 cDNA, wherein SEQ ID NO:64 is a clone designated herein as "DNA88136".

FIG. 65 shows a nucleotide sequence (SEQ ID NO:65) of a TAT474 cDNA, wherein SEQ ID NO:65 is a clone designated herein as "DNA88125".

FIG. 66 shows a nucleotide sequence (SEQ ID NO:66) of a TAT475 cDNA, wherein SEQ ID NO:66 is a clone designated herein as "DNA88140".

FIG. 67 shows a nucleotide sequence (SEQ ID NO:67) of a TAT476 cDNA, wherein SEQ ID NO:67 is a clone designated herein as "DNA226895".

FIG. 68 shows a nucleotide sequence (SEQ ID NO:68) of a TAT477 cDNA, wherein SEQ ID NO:68 is a clone designated herein as "DNA88127".

FIG. 69 shows a nucleotide sequence (SEQ ID NO:69) of a TAT478 cDNA, wherein SEQ ID NO:69 is a clone designated herein as "DNA219970".

FIG. 70 shows a nucleotide sequence (SEQ ID NO:70) of a TAT479 cDNA, wherein SEQ ID NO:70 is a clone designated herein as "DNA125146".

FIG. 71 shows a nucleotide sequence (SEQ ID NO:71) of a TAT480 cDNA, wherein SEQ ID NO:71 is a clone designated herein as "DNA287307".

FIG. 72 shows a nucleotide sequence (SEQ ID NO:72) of a TAT481 cDNA, wherein SEQ ID NO:72 is a clone designated herein as "DNA304872".

FIG. 73 shows a nucleotide sequence (SEQ ID NO:73) of a TAT482 cDNA, wherein SEQ ID NO:73 is a clone designated herein as "DNA327641".

FIG. 74 shows a nucleotide sequence (SEQ ID NO:74) of a TAT483 cDNA, wherein SEQ ID NO:74 is a clone designated herein as "DNA304666".

FIG. 75 shows a nucleotide sequence (SEQ ID NO:75) of a TAT484 cDNA, wherein SEQ ID NO:75 is a clone designated herein as "DNA226460".

FIG. 76 shows a nucleotide sequence (SEQ ID NO:76) of a TAT485 cDNA, wherein SEQ ID NO:76 is a clone designated herein as "DNA226479".

FIG. 77 shows a nucleotide sequence (SEQ ID NO:77) of a TAT486 cDNA, wherein SEQ ID NO:77 is a clone designated herein as "DNA271324".

FIG. 78 shows a nucleotide sequence (SEQ ID NO:78) of a TAT487 cDNA, wherein SEQ ID NO:78 is a clone designated herein as "DNA226619".

FIG. 79 shows a nucleotide sequence (SEQ ID NO:79) of a TAT488 cDNA, wherein SEQ ID NO:79 is a clone designated herein as "DNA327052".

FIG. 80 shows a nucleotide sequence (SEQ ID NO:80) of a TAT489 cDNA, wherein SEQ ID NO:80 is a clone designated herein as "DNA226162".

FIG. 81 shows a nucleotide sequence (SEQ ID NO:81) of a TAT490 cDNA, wherein SEQ ID NO:81 is a clone designated herein as "DNA272963".

FIG. 82 shows a nucleotide sequence (SEQ ID NO:82) of a TAT491 cDNA, wherein SEQ ID NO: 82 is a clone designated herein as "DNA222844".

FIG. 83 shows a nucleotide sequence (SEQ ID NO:83) of a TAT492 cDNA, wherein SEQ ID NO:83 is a clone designated herein as "DNA226473".

FIG. 84 shows a nucleotide sequence (SEQ ID NO:84) of a TAT493 cDNA, wherein SEQ ID NO:84 is a clone designated herein as "DNA226892".

FIG. 85 shows a nucleotide sequence (SEQ ID NO:85) of a TAT494 cDNA, wherein SEQ ID NO:85 is a clone designated herein as "DNA226895".

FIG. 86 shows a nucleotide sequence (SEQ ID NO:86) of a TAT495 cDNA, wherein SEQ ID NO:86 is a clone designated herein as "DNA226822".

FIG. 87 shows a nucleotide sequence (SEQ ID NO:87) of a TAT496 cDNA, wherein SEQ ID NO:87 is a clone designated herein as "DNA274759".

FIG. 88 shows a nucleotide sequence (SEQ ID NO:88) of a TAT497 cDNA, wherein SEQ ID NO:88 is a clone designated herein as "DNA227115".

FIG. 89 shows a nucleotide sequence (SEQ ID NO:89) of a TAT259 cDNA, wherein SEQ ID NO:89 is a clone designated herein as "DNA226027".

FIG. 90 shows a nucleotide sequence (SEQ ID NO:90) of a TAT498 cDNA, wherein SEQ ID NO:90 is a clone designated herein as "DNA226069".

FIG. 91 shows a nucleotide sequence (SEQ ID NO:91) of a TAT273 cDNA, wherein SEQ ID NO:91 is a clone designated herein as "DNA19902".

FIG. 92 shows a nucleotide sequence (SEQ ID NO:92) of a TAT265 cDNA, wherein SEQ ID NO:92 is a clone designated herein as "DNA288204".

FIG. 93 shows a nucleotide sequence (SEQ ID NO:93) of a TAT278 cDNA, wherein SEQ ID NO:93 is a clone designated herein as "DNA226446".

FIG. 94 shows a nucleotide sequence (SEQ ID NO:94) of a TAT499 cDNA, wherein SEQ ID NO:94 is a clone designated herein as "DNA50921".

FIG. 95 shows a nucleotide sequence (SEQ ID NO:95) of a TAT500 cDNA, wherein SEQ ID NO:95 is a clone designated herein as "DNA119506".

FIG. 96 shows a nucleotide sequence (SEQ ID NO:96) of a TAT506 cDNA, wherein SEQ ID NO:96 is a clone designated herein as "DNA226447".

FIG. 97 shows the amino acid sequence (SEQ ID NO:97) derived from the coding sequence of SEQ ID NO:1 shown in FIG. 1.

FIG. 98 shows the amino acid sequence (SEQ ID NO:98)m derived from the coding sequence of SEQ ID NO:2 shown in FIG. 2.

FIG. 99 shows the amino acid sequence (SEQ ID NO:99) derived from the coding sequence of SEQ ID NO:3 shown in FIG. 3.

FIG. 100 shows the amino acid sequence (SEQ ID NO:100) derived from the coding sequence of SEQ ID NO:4 shown in FIG. 4.

FIG. 101 shows the amino acid sequence (SEQ ID NO:101) derived from the coding sequence of SEQ ID NO:6 shown in FIG. 6.

FIG. 102 shows the amino acid sequence (SEQ ID NO:102) derived from the coding sequence of SEQ ID NO:7 shown in FIG. 7.

FIG. 103 shows the amino acid sequence (SEQ ID NO:103) derived from the coding sequence of SEQ ID NO:8 shown in FIG. 8.

FIG. 104 shows the amino acid sequence (SEQ ID NO:104) derived from the coding sequence of SEQ ID NO:9 shown in FIG. 9.

FIG. 105 shows the amino acid sequence (SEQ ID NO:105) derived from the coding sequence of SEQ ID NO:10 shown in FIG. 10.

FIG. 106 shows the amino acid sequence (SEQ ID NO:106) derived from the coding sequence of SEQ ID NO:11 shown in FIG. 11.

FIG. 107 shows the amino acid sequence (SEQ ID NO:107) derived from the coding sequence of SEQ ID NO:12 shown in FIG. 12.

FIG. 108 shows the amino acid sequence (SEQ ID NO:108) derived from the coding sequence of SEQ ID NO:13 shown in FIG. 13.

FIG. 109 shows the amino acid sequence (SEQ ID NO:109) derived from the coding sequence of SEQ ID NO:14 shown in FIG. 14.

FIG. 110 shows the amino acid sequence (SEQ ID NO:110) derived from the coding sequence of SEQ ID NO:15 shown in FIG. 15.

FIG. 111 shows the amino acid sequence (SEQ ID NO:111) derived from the coding sequence of SEQ ID NO:16 shown in FIG. 16.

FIG. 112 shows the amino acid sequence (SEQ ID NO:112) derived from the coding sequence of SEQ ID NO:17 shown in FIG. 17.

FIG. 113 shows the amino acid sequence (SEQ ID NO:113) derived from the coding sequence of SEQ ID NO:18 shown in FIG. 18.

FIG. 114 shows the amino acid sequence (SEQ ID NO:114) derived from the coding sequence of SEQ ID NO:19 shown in FIG. 19.

FIG. 115 shows the amino acid sequence (SEQ ID NO:115) derived from the coding sequence of SEQ ID NO:20 shown in FIG. 20.

FIG. 116 shows the amino acid sequence (SEQ ID NO:116) derived from the coding sequence of SEQ ID NO:21 shown in FIG. 21.

FIG. 117 shows the amino acid sequence (SEQ ID NO:117) derived from the coding sequence of SEQ ID NO:22 shown in FIG. 22.

FIG. 118 shows the amino acid sequence (SEQ ID NO:118) derived from the coding sequence of SEQ ID NO:23 shown in FIG. 23.

FIG. 119 shows the amino acid sequence (SEQ ID NO:119) derived from the coding sequence of SEQ ID NO:24 shown in FIG. 24.

FIG. 120 shows the amino acid sequence (SEQ ID NO:120) derived from the coding sequence of SEQ ID NO:25 shown in FIG. 25.

FIG. 121 shows the amino acid sequence (SEQ ID NO:121) derived from the coding sequence of SEQ ID NO:26 shown in FIG. 26.

FIG. 122 shows the amino acid sequence (SEQ ID NO:122) derived from the coding sequence of SEQ ID NO:27 shown in FIG. 27.

FIG. 123 shows the amino acid sequence (SEQ ID NO:123) derived from the coding sequence of SEQ ID NO:28 shown in FIG. 28.

FIG. 124 shows the amino acid sequence (SEQ ID NO:124) derived from the coding sequence of SEQ ID NO:29 shown in FIG. 29.

FIG. 125 shows the amino acid sequence (SEQ ID NO:125) derived from the coding sequence of SEQ ID NO:30 shown in FIG. 30.

FIG. 126 shows the amino acid sequence (SEQ ID NO:126) derived from the coding sequence of SEQ ID NO:31 shown in FIG. 31.

FIG. 127 shows the amino acid sequence (SEQ ID NO:127) derived from the coding sequence of SEQ ID NO:32 shown in FIG. 32.

FIG. 128 shows the amino acid sequence (SEQ ID NO:128) derived from the coding sequence of SEQ ID NO:33 shown in FIG. 33.

FIG. 129 shows the amino acid sequence (SEQ ID NO:129) derived from the coding sequence of SEQ ID NO:34 shown in FIG. 34.

FIG. 130 shows the amino acid sequence (SEQ ID NO:130) derived from the coding sequence of SEQ ID NO:35 shown in FIG. 35.

FIG. 131 shows the amino acid sequence (SEQ ID NO:131) derived from the coding sequence of SEQ ID NO:36 shown in FIG. 36.

FIG. 132 shows the amino acid sequence (SEQ ID NO:132) derived from the coding sequence of SEQ ID NO:37 shown in FIG. 37.

FIG. 133 shows the amino acid sequence (SEQ ID NO:133) derived from the coding sequence of SEQ ID NO:38 shown in FIG. 38.

FIG. 134 shows the amino acid sequence (SEQ ID NO:134) derived from the coding sequence of SEQ ID NO:39 shown in FIG. 39.

FIG. 135 shows the amino acid sequence (SEQ ID NO:135) derived from the coding sequence of SEQ ID NO:40 shown in FIG. 40.

FIG. 136 shows the amino acid sequence (SEQ ID NO:136) derived from the coding sequence of SEQ ID NO:41 shown in FIG. 41.

FIG. 137 shows the amino acid sequence (SEQ ID NO:137) derived from the coding sequence of SEQ ID NO:42 shown in FIG. 42.

FIG. 138 shows the amino acid sequence (SEQ ID NO:138) derived from the coding sequence of SEQ ID NO:43 shown in FIG. 43.

FIG. 139 shows the amino acid sequence (SEQ ID NO:139) derived from the coding sequence of SEQ ID NO:44 shown in FIG. 44.

FIG. 140 shows the amino acid sequence (SEQ ID NO:140) derived from the coding sequence of SEQ ID NO:45 shown in FIG. 45.

FIG. 141 shows the amino acid sequence (SEQ ID NO:141) derived from the coding sequence of SEQ ID NO:46 shown in FIG. 46.

FIG. 142 shows the amino acid sequence (SEQ ID NO:142) derived from the coding sequence of SEQ ID NO:47 shown in FIG. 47.

FIG. 143 shows the amino acid sequence (SEQ ID NO:143) derived from the coding sequence of SEQ ID NO:48 shown in FIG. 48.

FIG. 144 shows the amino acid sequence (SEQ ID NO:144) derived from the coding sequence of SEQ ID NO:49 shown in FIG. 49.

FIG. 145 shows the amino acid sequence (SEQ ID NO:145) derived from the coding sequence of SEQ ID NO:50 shown in FIG. 50.

FIG. 146 shows the amino acid sequence (SEQ ID NO:146) derived from the coding sequence of SEQ ID NO:51 shown in FIG. 51.

FIG. 147 shows the amino acid sequence (SEQ ID NO:147) derived from the coding sequence of SEQ ID NO:53 shown in FIG. 53.

FIG. 148 shows the amino acid sequence (SEQ ID NO:148) derived from the coding sequence of SEQ ID NO:54 shown in FIG. 54.

FIG. 149 shows the amino acid sequence (SEQ ID NO:149) derived from the coding sequence of SEQ ID NO:55 shown in FIG. 55.

FIG. 150 shows the amino acid sequence (SEQ ID NO:150) derived from the coding sequence of SEQ ID NO:56 shown in FIG. 56.

FIG. 151 shows the amino acid sequence (SEQ ID NO:151) derived from the coding sequence of SEQ ID NO:57 shown in FIG. 57.

FIG. 152 shows the amino acid sequence (SEQ ID NO:152) derived from the coding sequence of SEQ ID NO:58 shown in FIG. 58.

FIG. 153 shows the amino acid sequence (SEQ ID NO:153) derived from the coding sequence of SEQ ID NO:59 shown in FIG. 59.

FIG. 154 shows the amino acid sequence (SEQ ID NO:154) derived from the coding sequence of SEQ ID NO:60 shown in FIG. 60.

FIG. 155 shows the amino acid sequence (SEQ ID NO:155) derived from the coding sequence of SEQ ID NO:61 shown in FIG. 61.

FIG. 156 shows the amino acid sequence (SEQ ID NO:156) derived from the coding sequence of SEQ ID NO:62 shown in FIG. 62.

FIG. 157 shows the amino acid sequence (SEQ ID NO:157) derived from the coding sequence of SEQ ID NO:63 shown in FIG. 63.

FIG. 158 shows the amino acid sequence (SEQ ID NO:158) derived from the coding sequence of SEQ ID NO:64 shown in FIG. 64.

FIG. 159 shows the amino acid sequence (SEQ ID NO:159) derived from the coding sequence of SEQ ID NO:65 shown in FIG. 65.

FIG. 160 shows the amino acid sequence (SEQ ID NO:160) derived from the coding sequence of SEQ ID NO:66 shown in FIG. 66.

FIG. 161 shows the amino acid sequence (SEQ ID NO:161) derived from the coding sequence of SEQ ID NO:67 shown in FIG. 67.

FIG. 162 shows the amino acid sequence (SEQ ID NO:162) derived from the coding sequence of SEQ ID NO:68 shown in FIG. 68.

FIG. 163 shows the amino acid sequence (SEQ ID NO:163) derived from the coding sequence of SEQ ID NO:69 shown in FIG. 69.

FIG. 164 shows the amino acid sequence (SEQ ID NO:164) derived from the coding sequence of SEQ ID NO:70 shown in FIG. 70.

FIG. 165 shows the amino acid sequence (SEQ ID NO:165) derived from the coding sequence of SEQ ID NO:71 shown in FIG. 71.

FIG. 166 shows the amino acid sequence (SEQ ID NO:166) derived from the coding sequence of SEQ ID NO:72 shown in FIG. 72.

FIG. 167 shows the amino acid sequence (SEQ ID NO:167) derived from the coding sequence of SEQ ID NO:73 shown in FIG. 73.

FIG. 168 shows the amino acid sequence (SEQ ID NO:168) derived from the coding sequence of SEQ ID NO:74 shown in FIG. 74.

FIG. 169 shows the amino acid sequence (SEQ ID NO:169) derived from the coding sequence of SEQ ID NO:75 shown in FIG. 75.

FIG. 170 shows the amino acid sequence (SEQ ID NO:170) derived from the coding sequence of SEQ ID NO:76 shown in FIG. 76.

FIG. 171 shows the amino acid sequence (SEQ ID NO:171) derived from the coding sequence of SEQ ID NO:77 shown in FIG. 77.

FIG. 172 shows the amino acid sequence (SEQ ID NO:172) derived from the coding sequence of SEQ ID NO:78 shown in FIG. 78.

FIG. 173 shows the amino acid sequence (SEQ ID NO:173) derived from the coding sequence of SEQ ID NO:79 shown in FIG. 79.

FIG. 174 shows the amino acid sequence (SEQ ID NO:174) derived from the coding sequence of SEQ ID NO:80 shown in FIG. 80.

FIG. 175 shows the amino acid sequence (SEQ ID NO:175) derived from the coding sequence of SEQ ID NO:81 shown in FIG. 81.

FIG. 176 shows the amino acid sequence (SEQ ID NO:176) derived from the coding sequence of SEQ ID NO:82 shown in FIG. 82.

FIG. 177 shows the amino acid sequence (SEQ ID NO:177) derived from the coding sequence of SEQ ID NO:83 shown in FIG. 83.

FIG. 178 shows the amino acid sequence (SEQ ID NO:178) derived from the coding sequence of SEQ ID NO:84 shown in FIG. 84.

FIG. 179 shows the amino acid sequence (SEQ ID NO:179) derived from the coding sequence of SEQ ID NO:85 shown in FIG. 85.

FIG. 180 shows the amino acid sequence (SEQ ID NO:180) derived from the coding sequence of SEQ ID NO:86 shown in FIG. 86.

FIG. 181 shows the amino acid sequence (SEQ ID NO:181) derived from the coding sequence of SEQ ID NO:87 shown in FIG. 87.

FIG. 182 shows the amino acid sequence (SEQ ID NO:182) derived from the coding sequence of SEQ ID NO:88 shown in FIG. 88.

FIG. 183 shows the amino acid sequence (SEQ ID NO:183) derived from the coding sequence of SEQ. ID NO:89 shown in FIG. 89.

FIG. 184 shows the amino acid sequence (SEQ ID NO:184) derived from the coding sequence of SEQ ID NO:90 shown in FIG. 90.

FIG. 185 shows the amino acid sequence (SEQ ID NO:185) derived from the coding sequence of SEQ ID NO:91 shown in FIG. 91.

FIG. 186 shows the amino acid sequence (SEQ ID NO:186) derived from the coding sequence of SEQ ID NO:92 shown in FIG. 92.

FIG. 187 shows the amino acid sequence (SEQ ID NO:187) derived from the coding sequence of SEQ ID NO:93 shown in FIG. 93.

FIG. 188 shows the amino acid sequence (SEQ ID NO:188) derived from the coding sequence of SEQ ID NO:94 shown in FIG. 94.

FIG. 189 shows the amino acid sequence (SEQ ID NO:189) derived from the coding sequence of SEQ ID NO:95 shown in FIG. 95.

FIG. 190 shows the amino acid sequence (SEQ ID NO:190) derived from the coding sequence of SEQ ID NO:96 shown in FIG. 96.

DETAILED DESCRIPTION OF THE PREFERRED EMBODIMENTS

I. Definitions

The terms "TAT polypeptide" and "TAT" as used herein and when immediately followed by a numerical designation, refer to various polypeptides, wherein the complete designation (i.e., TAT/number) refers to specific polypeptide sequences as described herein. The terms "TAT/number polypeptide" and "TAT/number" wherein the term "number" is provided as an actual numerical designation as used herein encompass native sequence polypeptides, polypeptide variants and fragments of native sequence polypeptides and polypeptide variants (which are further defined herein). The TAT polypeptides described herein may be isolated from a variety of sources, such as from human tissue types or from another source, or prepared by recombinant or synthetic methods. The term "TAT polypeptide" refers to each individual TAT/number polypeptide disclosed herein. All disclosures in this specification which refer to the "TAT polypeptide" refer to each of the polypeptides individually as well as jointly. For example, descriptions of the preparation of, purification of, derivation of, formation of antibodies to or against, formation of TAT binding oligopeptides to or against, formation of TAT binding organic molecules to or against, administration of, compositions containing, treatment of a disease with, etc., pertain to each polypeptide of the invention individually. The term "TAT polypeptide" also includes variants of the TAT/number polypeptides disclosed herein.

A "native sequence TAT polypeptide" comprises a polypeptide having the same amino acid sequence as the corresponding TAT polypeptide derived from nature. Such native sequence TAT polypeptides can be isolated from nature or can be produced by recombinant or synthetic means. The term "native sequence TAT polypeptide" specifically encompasses naturally-occurring truncated or secreted forms of the specific TAT polypeptide (e.g., an extracellular domain sequence), naturally-occurring variant forms (e.g., alternatively spliced forms) and naturally-occurring allelic variants of the polypeptide. In certain embodiments of the invention, the native sequence TAT polypeptides disclosed herein are mature or full-length native sequence polypeptides comprising the full-length amino acids sequences shown in the accompanying figures. Start and stop codons (if indicated) are shown in bold font and underlined in the figures. Nucleic acid residues indicated as "N" or "X" in the accompanying figures are any nucleic acid residue. However, while the TAT polypeptides disclosed in the accompanying figures are shown to begin with methionine residues designated herein as amino acid position 1 in the figures, it is conceivable and possible that other methionine residues located either upstream or downstream from the amino acid position 1 in the figures may be employed as the starting amino acid residue for the TAT polypeptides.

The TAT polypeptide "extracellular domain" or "ECD" refers to a form of the TAT polypeptide which is essentially free of the transmembrane and cytoplasmic domains. Ordinarily, a TAT polypeptide ECD will have less than 1% of such transmembrane and/or cytoplasmic domains and preferably, will have less than 0.5% of such domains. It will be understood that any transmembrane domains identified for the TAT polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a TAT polypeptide may contain from about 5 or fewer amino acids on either side of the transmembrane domain/extracellular domain boundary as identified in the Examples or specification and such polypeptides, with or without the associated signal peptide, and nucleic acid encoding them, are contemplated by the present invention.

The approximate location of the "signal peptides" of the various TAT polypeptides disclosed herein may be shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., *Prot. Eng.* 10:1-6 (1997) and von Heinje et al., *Nucl. Acids. Res.* 14:4683-4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention.

"TAT polypeptide variant" means a TAT polypeptide, preferably an active TAT polypeptide, as defined herein having at least about 80% amino acid sequence identity with a full-length native sequence TAT polypeptide sequence as disclosed herein, a TAT polypeptide sequence lacking the signal peptide as disclosed herein, an extracellular domain of a TAT polypeptide, with or without the signal peptide, as disclosed herein or any other fragment of a full-length TAT polypeptide sequence as disclosed herein (such as those encoded by a nucleic acid that represents only a portion of the complete coding sequence for a full-length TAT polypeptide). Such TAT polypeptide variants include, for instance, TAT polypeptides wherein one or more amino acid residues are added, or deleted, at the N- or C-terminus of the full-length native amino acid sequence. Ordinarily, a TAT polypeptide variant will have at least about 80% amino acid sequence identity, alternatively at least about 81%, 82%, 83%, 84%, 85%, 86%, 87%, 88%, 89%, 90%, 91%, 92%, 93%, 94%, 95%, 96%, 97%, 98%, or 99% amino acid sequence identity, to a full-length native sequence TAT polypeptide sequence as disclosed herein, a TAT polypeptide sequence lacking the signal peptide as disclosed herein, an extracellular domain of a TAT polypeptide, with or without the signal peptide, as disclosed herein or any other specifically defined fragment of a full-length TAT polypeptide sequence as disclosed herein. Ordinarily, TAT variant polypeptides are at least about 10 amino acids in length, alternatively at least about 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600 amino acids in length, or more. Optionally, TAT variant polypeptides will have no more than one conservative amino acid substitution as compared to the native TAT polypeptide sequence, alternatively no more than 2, 3, 4, 5, 6, 7, 8, 9, or 10 conservative amino acid substitution as compared to the native TAT polypeptide sequence.

"Percent (%) amino acid sequence identity" with respect to the TAT polypeptide sequences identified herein is defined as the percentage of amino acid residues in a candidate sequence that are identical with the amino acid residues in the specific TAT polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. For purposes herein, however, % amino acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. As examples of % amino acid sequence identity calculations using this method, Tables 2 and 3 demonstrate how to calculate the % amino acid sequence identity of the amino acid sequence designated "Comparison Protein" to the amino acid sequence designated "TAT", wherein "TAT" represents the amino acid sequence of a hypothetical TAT polypeptide of interest, "Comparison Protein" represents the amino acid sequence of a polypeptide against which the "TAT" polypeptide of interest is being compared, and "X", "Y" and "Z" each represent different hypothetical amino acid residues. Unless specifically stated otherwise, all % amino acid sequence identity values used herein are obtained as described in the immediately preceding paragraph using the ALIGN-2 computer program.

"TAT variant polynucleotide" or "TAT variant nucleic acid sequence" means a nucleic acid molecule which encodes a TAT polypeptide, preferably an active TAT polypeptide, as defined herein and which has at least about 80% nucleic acid sequence identity with a nucleotide acid sequence encoding a full-length native sequence TAT polypeptide sequence as disclosed herein, a full-length native sequence TAT polypeptide sequence lacking the signal peptide as disclosed herein, an extracellular domain of a TAT polypeptide, with or without the signal peptide, as disclosed herein or any other fragment of a full-length TAT polypeptide sequence as disclosed herein (such as those encoded by a nucleic acid that represents only a portion of the complete coding sequence for a full-length TAT polypeptide). Ordinarily, a TAT variant polynucleotide will have at least about 80% nucleic acid sequence identity, alternatively at least about 81%, 82%, 83%, 84%, 85%, 86%, 87%, 88%, 89%, 90%, 91%, 92%, 93%, 94%, 95%, 96%, 97%, 98%, or 99% nucleic acid sequence identity with a nucleic acid sequence encoding a full-length native sequence TAT polypeptide sequence as disclosed herein, a full-length native sequence TAT polypeptide sequence lacking the signal peptide as disclosed herein, an extracellular domain of a TAT polypeptide, with or without the signal sequence, as disclosed herein or any other fragment of a full-length TAT polypeptide sequence as disclosed herein. Variants do not encompass the native nucleotide sequence.

Ordinarily, TAT variant polynucleotides are at least about 5 nucleotides in length, alternatively at least about 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleotides in length, wherein in this context the term "about" means the referenced nucleotide sequence length plus or minus 10% of that referenced length.

"Percent (%) nucleic acid sequence identity" with respect to TAT-encoding nucleic acid sequences identified herein is defined as the percentage of nucleotides in a candidate sequence that are identical with the nucleotides in the TAT nucleic acid sequence of interest, after aligning the sequences and introducing gaps, if necessary, to achieve the maximum percent sequence identity. Alignment for purposes of determining percent nucleic acid sequence identity can be achieved in various ways that are within the skill in the art, for instance, using publicly available computer software such as BLAST, BLAST-2, ALIGN or Megalign (DNASTAR) software. For purposes herein, however, % nucleic acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for nucleic acid sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4 and 5, demonstrate how to calculate the % nucleic acid sequence identity of the nucleic acid sequence designated "Comparison DNA" to the nucleic acid sequence designated "TAT-DNA", wherein "TAT-DNA" represents a hypothetical TAT-encoding nucleic acid sequence of interest, "Comparison DNA" represents the nucleotide sequence of a nucleic acid molecule against which the "TAT-DNA" nucleic acid molecule of interest is being compared, and "N", "L" and "V" each represent different hypothetical nucleotides. Unless specifically stated otherwise, all % nucleic acid sequence identity values used herein are obtained as described in the immediately preceding paragraph using the ALIGN-2 computer program.

In other embodiments, TAT variant polynucleotides are nucleic acid molecules that encode a TAT polypeptide and which are capable of hybridizing, preferably under stringent hybridization and wash conditions, to nucleotide sequences encoding a full-length TAT polypeptide as disclosed herein. TAT variant polypeptides may be those that are encoded by a TAT variant polynucleotide.

The term "full-length coding region" when used in reference to a nucleic acid encoding a TAT polypeptide refers to the sequence of nucleotides which encode the full-length TAT polypeptide of the invention (which is often shown between start and stop codons, inclusive thereof, in the accompanying figures). The term "full-length coding region" when used in reference to an ATCC deposited nucleic acid refers to the TAT polypeptide-encoding portion of the cDNA that is inserted into the vector deposited with the ATCC (which is often shown between start and stop codons, inclusive thereof, in the accompanying figures).

"Isolated," when used to describe the various TAT polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the TAT polypeptide natural environment will not be present. Ordinarily, however, isolated polypeptide will be prepared by at least one purification step.

An "isolated" TAT polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, may be identified by those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) overnight hybridization in a solution that employs 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with a 10 minute wash at 42° C. in 0.2×SSC (sodium chloride/sodium citrate) followed by a 10 minute high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

The term "epitope tagged" when used herein refers to a chimeric polypeptide comprising a TAT polypeptide or anti-TAT antibody fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

"Active" or "activity" for the purposes herein refers to form(s) of a TAT polypeptide which retain a biological and/or an immunological activity of native or naturally-occurring TAT, wherein "biological" activity refers to a biological function (either inhibitory or stimulatory) caused by a native or naturally-occurring TAT other than the ability to induce the production of an antibody against an antigenic epitope possessed by a native or naturally-occurring TAT and an "immunological" activity refers to the ability to induce the production of an antibody against an antigenic epitope possessed by a native or naturally-occurring TAT.

The term "antagonist" is used in the broadest sense, and includes any molecule that partially or fully blocks, inhibits, or neutralizes a biological activity of a native TAT polypeptide disclosed herein. In a similar manner, the term "agonist" is used in the broadest sense and includes any molecule that mimics a biological activity of a native TAT polypeptide disclosed herein. Suitable agonist or antagonist molecules specifically include agonist or antagonist antibodies or antibody fragments, fragments or amino acid sequence variants of native TAT polypeptides, peptides, antisense oligonucleotides, small organic molecules, extracellular domains of TAT polypeptides, etc. Methods for identifying agonists or antagonists of a TAT polypeptide may comprise contacting a TAT polypeptide with a candidate agonist or antagonist molecule and measuring a detectable change in one or more biological activities normally associated with the TAT polypeptide. In general, we have found that in many, but not all, cases, type A antigens as defined herein have a growth inhibiting effect on glial tumor cells. As such, in one embodiment of the present invention, one may employ agonists of type A antigens (e.g., type A antigens-derived polypeptides, e.g., extracellular domains, agonist antibodies, etc.) for inhibiting the growth of glial tumor cells.

"Treating" or "treatment" or "alleviation" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented. A subject or mammal is successfully "treated" for a TAT polypeptide-expressing cancer if, after receiving a therapeutic amount of an anti-TAT antibody, TAT binding oligopeptide or TAT binding organic molecule according to the methods of the present invention, the patient shows observable and/or measurable reduction in or absence of one or more of the following: reduction in the number of cancer cells or absence of the cancer cells; reduction in the tumor size; inhibition (i.e., slow to some extent and preferably stop) of cancer cell infiltration into peripheral organs including the spread of cancer into soft tissue and bone; inhibition (i.e., slow to some extent and preferably stop) of tumor metastasis; inhibition, to some extent, of tumor growth; and/or relief to some extent, one or more of the symptoms associated with the specific cancer; reduced morbidity and mortality, and improvement in quality of life issues. Additionally, with specific regard to tumors of glial origin (because tumors of glial origin are well known to be highly invasive into surrounding brain tissue), a subject or mammal is successfully "treated" if, after receiving a therapeutic amount of an anti-TAT antibody, TAT binding oligopeptide or TAT binding organic molecule according to the methods of the present invention, the patient shows observable and/or measurable reduction in the invasiveness or migration of glial tumor cells into surrounding brain tissue. To the extent the anti-TAT antibody or TAT binding oligopeptide may prevent growth and/or kill existing cancer cells, it may be cytostatic and/or cytotoxic. Reduction of these signs or symptoms may also be felt by the patient.

The above parameters for assessing successful treatment and improvement in the disease are readily measurable by routine procedures familiar to a physician. For cancer therapy, efficacy can be measured, for example, by assessing the time to disease progression (TTP) and/or determining the response rate (RR). Metastasis can be determined by staging tests and by bone scan and tests for calcium level and other enzymes to determine spread to the bone. CT scans can also be done to look for spread to the pelvis and lymph nodes in the area. Chest X-rays and measurement of liver enzyme levels by known methods are used to look for metastasis to the lungs and liver, respectively. Other routine methods for monitoring the disease include transrectal ultrasonography (TRUS) and transrectal needle biopsy (TRNB). With specific regard to tumors of glial origin, one may also employ MRI analyses to successful treatment and/or improvement of the disease.

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

"Mammal" for purposes of the treatment of, alleviating the symptoms of or diagnosis of a cancer refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN®, polyethylene glycol (PEG), and PLURONICS®.

By "solid phase" or "solid support" is meant a non-aqueous matrix to which an antibody, TAT binding oligopeptide or TAT binding organic molecule of the present invention can adhere or attach. Examples of solid phases encompassed herein include those formed partially or entirely of glass (e.g., controlled pore glass), polysaccharides (e.g., agarose), polyacrylamides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat. No. 4,275,149.

A "liposome" is a small vesicle composed of various types of lipids, phospholipids and/or surfactant which is useful for delivery of a drug (such as a TAT polypeptide, an antibody thereto or a TAT binding oligopeptide) to a mammal. The components of the liposome are commonly arranged in a bilayer formation, similar to the lipid arrangement of biological membranes.

A "small" molecule or "small" organic molecule is defined herein to have a molecular weight below about 500 Daltons.

An "effective amount" of a polypeptide, antibody, TAT binding oligopeptide, TAT binding organic molecule or an agonist or antagonist thereof as disclosed herein is an amount sufficient to carry out a specifically stated purpose. An "effective amount" may be determined empirically and in a routine manner, in relation to the stated purpose.

The term "therapeutically effective amount" refers to an amount of an antibody, polypeptide, TAT binding oligopeptide, TAT binding organic molecule or other drug effective to "treat" a disease or disorder in a subject or mammal. In the case of cancer, the therapeutically effective amount of the drug may reduce the number of cancer cells; reduce the tumor size; inhibit (i.e., slow to some extent and preferably stop) cancer cell infiltration into peripheral organs; inhibit (i.e., slow to some extent and preferably stop) tumor metastasis; inhibit, to some extent, tumor growth; and/or relieve to some extent one or more of the symptoms associated with the cancer. See the definition herein of "treating". To the extent the drug may prevent growth and/or kill existing cancer cells, it may be cytostatic and/or cytotoxic.

A "growth inhibitory amount" of an anti-TAT antibody, TAT polypeptide, TAT binding oligopeptide or TAT binding organic molecule is an amount capable of inhibiting the growth of a cell, especially tumor, e.g., cancer cell, either in vitro or in vivo. A "growth inhibitory amount" of an anti-TAT antibody, TAT polypeptide, TAT binding oligopeptide or TAT binding organic molecule for purposes of inhibiting neoplastic cell growth may be determined empirically and in a routine manner.

A "cytotoxic amount" of an anti-TAT antibody, TAT polypeptide, TAT binding oligopeptide or TAT binding organic molecule is an amount capable of causing the destruction of a cell, especially tumor, e.g., cancer cell, either in vitro or in vivo. A "cytotoxic amount" of an anti-TAT antibody, TAT polypeptide, TAT binding oligopeptide or TAT binding organic molecule for purposes of inhibiting neoplastic cell growth may be determined empirically and in a routine manner.

The term "antibody" is used in the broadest sense and specifically covers, for example, single anti-TAT monoclonal antibodies (including agonist, antagonist, and neutralizing antibodies), anti-TAT antibody compositions with polyepitopic specificity, polyclonal antibodies, single chain anti-TAT antibodies, and fragments of anti-TAT antibodies (see below) as long as they exhibit the desired biological or immunological activity. The term "immunoglobulin" (Ig) is used interchangeable with antibody herein.

An "isolated antibody" is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The basic 4-chain antibody unit is a heterotetrameric glycoprotein composed of two identical light (L) chains and two identical heavy (H) chains (an IgM antibody consists of 5 of the basic heterotetramer unit along with an additional polypeptide called J chain, and therefore contain 10 antigen binding sites, while secreted IgA antibodies can polymerize to form polyvalent assemblages comprising 2-5 of the basic 4-chain units along with J chain). In the case of IgGs, the 4-chain unit is generally about 150,000 daltons. Each L chain is linked to a H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable domain ($V_H$) followed by three constant domains ($C_H$) for each of the $\alpha$ and $\gamma$ chains and four $C_H$ domains for $\mu$ and $\epsilon$ isotypes. Each L chain has at the N-terminus, a variable domain ($V_L$) followed by a constant domain ($C_L$) at its other end. The $V_L$ is aligned with the $V_H$ and the $C_L$ is aligned with the first constant domain of the heavy chain ($C_H1$). Particular amino acid residues are believed to form an interface between the light chain and heavy chain variable domains. The pairing of a $V_H$ and $V_L$ together forms a single antigen-binding site. For the structure and properties of the different classes of antibodies, see, e.g., *Basic and Clinical Immunology*, 8th edition, Daniel P. Stites, Abba I. Terr and Tristram G. Parslow (eds.), Appleton & Lange, Norwalk, Conn., 1994, page 71 and Chapter 6.

The L chain from any vertebrate species can be assigned to one of two clearly distinct types, called kappa and lambda, based on the amino acid sequences of their constant domains. Depending on the amino acid sequence of the constant domain of their heavy chains ($C_H$), immunoglobulins can be assigned to different classes or isotypes. There are five classes of immunoglobulins: IgA, IgD, IgE, IgG, and IgM, having heavy chains designated α, δ, ε, γ, and μ, respectively. The γ and α classes are further divided into subclasses on the basis of relatively minor differences in $C_H$ sequence and function, e.g., humans express the following subclasses: IgG1, IgG2, IgG3, IgG4, IgA1, and IgA2.

The term "variable" refers to the fact that certain segments of the variable domains differ extensively in sequence among antibodies. The V domain mediates antigen binding and define specificity of a particular antibody for its particular antigen. However, the variability is not evenly distributed across the 110-amino acid span of the variable domains. Instead, the V regions consist of relatively invariant stretches called framework regions (FRs) of 15-30 amino acids separated by shorter regions of extreme variability called "hypervariable regions" that are each 9-12 amino acids long. The variable domains of native heavy and light chains each comprise four FRs, largely adopting a μ-sheet configuration, connected by three hypervariable regions, which form loops connecting, and in some cases forming part of, the β-sheet structure. The hypervariable regions in each chain are held together in close proximity by the FRs and, with the hypervariable regions from the other chain, contribute to the formation of the antigen-binding site of antibodies (see Kabat et al., *Sequences of Proteins of Immunological Interest,* 5th Ed. Public Health Service, National Institutes of Health, Bethesda, Md. (1991)). The constant domains are not involved directly in binding an antibody to an antigen, but exhibit various effector functions, such as participation of the antibody in antibody dependent cellular cytotoxicity (ADCC).

The term "hypervariable region" when used herein refers to the amino acid residues of an antibody which are responsible for antigen-binding. The hypervariable region generally comprises amino acid residues from a "complementarity determining region" or "CDR" (e.g. around about residues 24-34 (L1), 50-56 (L2) and 89-97 (L3) in the $V_L$, and around about 1-35 (H2), 50-65 (H2) and 95-102 (H3) in the $V_H$; Kabat et al., *Sequences of Proteins of Immunological Interest,* 5th Ed. Public Health Service, National Institutes of Health, Bethesda, Md. (1991)) and/or those residues from a "hypervariable loop" (e.g. residues 26-32 (L1), 50-52 (L2) and 91-96 (L3) in the $V_L$, and 26-32 (H2), 53-55 (H2) and 96-101 (H3) in the $V_H$; Chothia and Lesk *J. Mol. Biol.* 196:901-917 (1987)).

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to polyclonal antibody preparations which include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" is not to be construed as requiring production of the antibody by any particular method. For example, the monoclonal antibodies useful in the present invention may be prepared by the hybridoma methodology first described by Kohler et al., *Nature,* 256: 495 (1975), or may be made using recombinant DNA methods in bacterial, eukaryotic animal or plant cells (see, e.g., U.S. Pat. No. 4,816, 567). The "monoclonal antibodies" may also be isolated from phage antibody libraries using the techniques described in Clackson et al., *Nature,* 352:624-628 (1991) and Marks et al., *J. Mol. Biol.,* 222:581-597 (1991), for example.

The monoclonal antibodies herein include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see U.S. Pat. No. 4,816,567; and Morrison et al., *Proc. Natl. Acad. Sci. USA,* 81:6851-6855 (1984)). Chimeric antibodies of interest herein include "primatized" antibodies comprising variable domain antigen-binding sequences derived from a non-human primate (e.g. Old World Monkey, Ape etc), and human constant region sequences.

An "intact" antibody is one which comprises an antigen-binding site as well as a $C_L$ and at least heavy chain constant domains, $C_H1$, $C_H2$ and $C_H3$. The constant domains may be native sequence constant domains (e.g. human native sequence constant domains) or amino acid sequence variant thereof. Preferably, the intact antibody has one or more effector functions.

"Antibody fragments" comprise a portion of an intact antibody, preferably the antigen binding or variable region of the intact antibody. Examples of antibody fragments include Fab, Fab', $F(ab')_2$ and Fv fragments; diabodies; linear antibodies (see U.S. Pat. No. 5,641,870, Example 2; Zapata et al., *Protein Eng.* 8(10): 1057-1062 [1995]); single-chain antibody molecules; and multispecific antibodies formed from antibody fragments.

Papain digestion of antibodies produces two identical antigen-binding fragments, called "Fab" fragments, and a residual "Fc" fragment, a designation reflecting the ability to crystallize readily. The Fab fragment consists of an entire L chain along with the variable region domain of the H chain ($V_H$), and the first constant domain of one heavy chain ($C_H1$). Each Fab fragment is monovalent with respect to antigen binding, i.e., it has a single antigen-binding site. Pepsin treatment of an antibody yields a single large $F(ab')_2$ fragment which roughly corresponds to two disulfide linked Fab fragments having divalent antigen-binding activity and is still capable of cross-linking antigen. Fab' fragments differ from Fab fragments by having additional few residues at the carboxy terminus of the $C_H1$ domain including one or more cysteines from the antibody hinge region. Fab'-SH is the designation herein for Fab' in which the cysteine residue(s) of the constant domains bear a free thiol group. $F(ab')_2$ antibody fragments originally were produced as pairs of Fab' fragments which have hinge cysteines between them. Other chemical couplings of antibody fragments are also known.

The Fc fragment comprises the carboxy-terminal portions of both H chains held together by disulfides. The effector functions of antibodies are determined by sequences in the Fc region, which region is also the part recognized by Fc receptors (FcR) found on certain types of cells.

"Fv" is the minimum antibody fragment which contains a complete antigen-recognition and -binding site. This fragment consists of a dimer of one heavy- and one light-chain variable region domain in tight, non-covalent association. From the folding of these two domains emanate six hypervariable loops (3 loops each from the H and L chain) that contribute the amino acid residues for antigen binding and confer antigen binding specificity to the antibody. However, even a single variable domain (or half of an Fv comprising only three CDRs specific for an antigen) has the ability to recognize and bind antigen, although at a lower affinity than the entire binding site.

"Single-chain Fv" also abbreviated as "sFv" or "scFv" are antibody fragments that comprise the $V_H$ and $V_L$ antibody domains connected into a single polypeptide chain. Preferably, the sFv polypeptide further comprises a polypeptide linker between the $V_H$ and $V_L$ domains which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269-315 (1994); Borrebaeck 1995, infra.

The term "diabodies" refers to small antibody fragments prepared by constructing sFv fragments (see preceding paragraph) with short linkers (about 5-10 residues) between the $V_H$ and $V_L$ domains such that inter-chain but not intra-chain pairing of the V domains is achieved, resulting in a bivalent fragment, i.e., fragment having two antigen-binding sites. Bispecific diabodies are heterodimers of two "crossover" sFv fragments in which the $V_H$ and $V_L$ domains of the two antibodies are present on different polypeptide chains. Diabodies are described more fully in, for example, EP 404,097; WO 93/11161; and Hollinger et al., Proc. Natl. Acad. Sci. USA, 90:6444-6448 (1993).

"Humanized" forms of non-human (e.g., rodent) antibodies are chimeric antibodies that contain minimal sequence derived from the non-human antibody. For the most part, humanized antibodies are human immunoglobulins (recipient antibody) in which residues from a hypervariable region of the recipient are replaced by residues from a hypervariable region of a non-human species (donor antibody) such as mouse, rat, rabbit or non-human primate having the desired antibody specificity, affinity, and capability. In some instances, framework region (FR) residues of the human immunoglobulin are replaced by corresponding non-human residues. Furthermore, humanized antibodies may comprise residues that are not found in the recipient antibody or in the donor antibody. These modifications are made to further refine antibody performance. In general, the humanized antibody will comprise substantially all of at least one, and typically two, variable domains, in which all or substantially all of the hypervariable loops correspond to those of a non-human immunoglobulin and all or substantially all of the FRs are those of a human immunoglobulin sequence. The humanized antibody optionally also will comprise at least a portion of an immunoglobulin constant region (Fc), typically that of a human immunoglobulin. For further details, see Jones et al., *Nature* 321:522-525 (1986); Riechmann et al., *Nature* 332: 323-329 (1988); and Presta, *Curr. Op. Struct. Biol.* 2:593-596 (1992).

A "species-dependent antibody," e.g., a mammalian anti-human IgE antibody, is an antibody which has a stronger binding affinity for an antigen from a first mammalian species than it has for a homologue of that antigen from a second mammalian species. Normally, the species-dependent antibody "bind specifically" to a human antigen (i.e., has a binding affinity (Kd) value of no more than about $1\times10^{-7}$ M, preferably no more than about $1\times10^{-8}$ and most preferably no more than about $1\times10^{-9}$ M) but has a binding affinity for a homologue of the antigen from a second non-human mammalian species which is at least about 50 fold, or at least about 500 fold, or at least about 1000 fold, weaker than its binding affinity for the human antigen. The species-dependent antibody can be of any of the various types of antibodies as defined above, but preferably is a humanized or human antibody.

A "TAT binding oligopeptide" is an oligopeptide that binds, preferably specifically, to a TAT polypeptide as described herein. TAT binding oligopeptides may be chemically synthesized using known oligopeptide synthesis methodology or may be prepared and purified using recombinant technology. TAT binding oligopeptides are usually at least about 5 amino acids in length, alternatively at least about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 amino acids in length or more, wherein such oligopeptides that are capable of binding, preferably specifically, to a TAT polypeptide as described herein. TAT binding oligopeptides may be identified without undue experimentation using well known techniques. In this regard, it is noted that techniques for screening oligopeptide libraries for oligopeptides that are capable of specifically binding to a polypeptide target are well known in the art (see, e.g., U.S. Pat. Nos. 5,556,762, 5,750,373, 4,708,871, 4,833,092, 5,223,409, 5,403,484, 5,571,689, 5,663,143; PCT Publication Nos. WO 84/03506 and WO84/03564; Geysen et al., Proc. Natl. Acad. Sci. U.S.A., 81:3998-4002 (1984); Geysen et al., Proc. Natl. Acad. Sci. U.S.A., 82:178-182 (1985); Geysen et al., in Synthetic Peptides as Antigens, 130-149 (1986); Geysen et al., J. Immunol. Meth., 102:259-274 (1987); Schoofs et al., J. Immunol., 140:611-616 (1988), Cwirla, S. E. et al. (1990) Proc. Natl. Acad. Sci. USA, 87:6378; Lowman, H. B. et al. (1991) Biochemistry, 30:10832; Clackson, T. et al. (1991) Nature, 352: 624; Marks, J. D. et al. (1991), J. Mol. Biol., 222:581; Kang, A. S. et al. (1991) Proc. Natl. Acad. Sci. USA, 88:8363, and Smith, G. P. (1991) Current Opin. Biotechnol., 2:668).

A "TAT binding organic molecule" is an organic molecule other than an oligopeptide or antibody as defined herein that binds, preferably specifically, to a TAT polypeptide as described herein. TAT binding organic molecules may be identified and chemically synthesized using known methodology (see, e.g., PCT Publication Nos. WO00/00823 and WO00/39585). TAT binding organic molecules are usually less than about 2000 daltons in size, alternatively less than about 1500, 750, 500, 250 or 200 daltons in size, wherein such organic molecules that are capable of binding, preferably specifically, to a TAT polypeptide as described herein may be identified without undue experimentation using well known techniques. In this regard, it is noted that techniques for screening organic molecule libraries for molecules that are capable of binding to a polypeptide target are well known in the art (see, e.g., PCT Publication Nos. WO00/00823 and WO00/39585).

An antibody, oligopeptide or other organic molecule "which binds" an antigen of interest, e.g. a tumor-associated polypeptide antigen target, is one that binds the antigen with sufficient affinity such that the antibody, oligopeptide or other organic molecule is useful as a diagnostic and/or therapeutic agent in targeting a cell or tissue expressing the antigen, and does not significantly cross-react with other proteins. In such embodiments, the extent of binding of the antibody, oligopeptide or other organic molecule to a "non-target" protein will be less than about 10% of the binding of the antibody, oligopeptide or other organic molecule to its particular target protein as determined by fluorescence activated cell sorting (FACS) analysis or radioimmunoprecipitation (RIA). With regard to the binding of an antibody, oligopeptide or other organic molecule to a target molecule, the term "specific binding" or "specifically binds to" or is "specific for" a particular polypeptide or an epitope on a particular polypeptide target means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target, for example, an excess of non-labeled target. In this case, specific binding is indicated if the binding of the labeled target to a probe is competitively inhibited by excess unlabeled target. The term "specific binding" or "specifically binds to" or is "specific for" a particular polypeptide or an epitope on a particular polypeptide target as used herein can be exhibited, for example, by a molecule having a Kd for the target of at least about $10^{-4}$M, alternatively at least about $10^{-5}$ M, alternatively at least about $10^{-6}$ M, alternatively at least about $10^{-7}$ M, alternatively at least about $10^{-8}$ M, alternatively at least about $10^{-9}$ M, alternatively at least about $10^{-10}$ M, alternatively at least about $10^{-11}$ M, alternatively at least about $10^{-12}$ M, or greater. In one embodiment, the term "specific binding" refers to binding where a molecule binds to a particular polypeptide or epitope on a particular polypeptide without substantially binding to any other polypeptide or polypeptide epitope.

An antibody, oligopeptide or other organic molecule that "inhibits the growth of tumor cells expressing a TAT polypeptide" or a "growth inhibitory" antibody, oligopeptide or other organic molecule is one which results in measurable growth inhibition of cancer cells expressing or overexpressing the appropriate TAT polypeptide. The TAT polypeptide may be a transmembrane polypeptide expressed on the surface of a cancer cell or may be a polypeptide that is produced and secreted by a cancer cell. Preferred growth inhibitory anti-TAT antibodies, oligopeptides or organic molecules inhibit growth of TAT-expressing tumor cells by greater than 20%, preferably from about 20% to about 50%, and even more preferably, by greater than 50% (e.g., from about 50% to about 100%) as compared to the appropriate control, the control typically being tumor cells not treated with the antibody, oligopeptide or other organic molecule being tested. In one embodiment, growth inhibition can be measured at an antibody concentration of about 0.1 to 30 μg/ml or about 0.5 nM to 200 nM in cell culture, where the growth inhibition is determined 1-10 days after exposure of the tumor cells to the antibody. Growth inhibition of tumor cells in vivo can be determined in various ways such as is described in the Experimental Examples section below. The antibody is growth inhibitory in vivo if administration of the anti-TAT antibody at about 1 μg/kg to about 100 mg/kg body weight results in reduction in tumor size or tumor cell proliferation within about 5 days to 3 months from the first administration of the antibody, preferably within about 5 to 30 days.

An antibody, oligopeptide or other organic molecule which "induces apoptosis" is one which induces programmed cell death as determined by binding of annexin V, fragmentation of DNA, cell shrinkage, dilation of endoplasmic reticulum, cell fragmentation, and/or formation of membrane vesicles (called apoptotic bodies). The cell is usually one which overexpresses a TAT polypeptide. Preferably the cell is a tumor cell, e.g., a glial- or other brain tissue-derived tumor cell. Various methods are available for evaluating the cellular events associated with apoptosis. For example, phosphatidyl serine (PS) translocation can be measured by annexin binding; DNA fragmentation can be evaluated through DNA laddering; and nuclear/chromatin condensation along with DNA fragmentation can be evaluated by any increase in hypodiploid cells. Preferably, the antibody, oligopeptide or other organic molecule which induces apoptosis is one which results in about 2 to 50 fold, preferably about 5 to 50 fold, and most preferably about 10 to 50 fold, induction of annexin binding relative to untreated cell in an annexin binding assay.

Antibody "effector functions" refer to those biological activities attributable to the Fc region (a native sequence Fc region or amino acid sequence variant Fc region) of an antibody, and vary with the antibody isotype. Examples of antibody effector functions include: C1q binding and complement dependent cytotoxicity; Fc receptor binding; antibody-dependent cell-mediated cytotoxicity (ADCC); phagocytosis; down regulation of cell surface receptors (e.g., B cell receptor); and B cell activation.

"Antibody-dependent cell-mediated cytotoxicity" or "ADCC" refers to a form of cytotoxicity in which secreted Ig bound onto Fc receptors (FcRs) present on certain cytotoxic cells (e.g., Natural Killer (NK) cells, neutrophils, and macrophages) enable these cytotoxic effector cells to bind specifically to an antigen-bearing target cell and subsequently kill the target cell with cytotoxins. The antibodies "arm" the cytotoxic cells and are absolutely required for such killing. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, *Annu. Rev. Immunol.* 9:457-92 (1991). To assess ADCC activity of a molecule of interest, an in vitro ADCC assay, such as that described in U.S. Pat. No. 5,500,362 or 5,821,337 may be performed. Useful effector cells for such assays include peripheral blood mononuclear cells (PBMC) and Natural Killer (NK) cells. Alternatively, or additionally, ADCC activity of the molecule of interest may be assessed in vivo, e.g., in a animal model such as that disclosed in Clynes et al. (USA) 95:652-656 (1998).

"Fc receptor" or "FcR" describes a receptor that binds to the Fc region of an antibody. The preferred FcR is a native sequence human FcR. Moreover, a preferred FcR is one which binds an IgG antibody (a gamma receptor) and includes receptors of the Fc γRI, FcγRII and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain. (see review M. in Daëron, *Annu. Rev. Immunol.* 15:203-234 (1997)). FcRs are reviewed in Ravetch and Kinet, *Annu. Rev. Immunol.* 9:457-492 (1991); Capel et al., *Immunomethods* 4:25-34 (1994); and de Haas et al., *J. Lab. Clin. Med.* 126:330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al., *J. Immunol.* 117:587 (1976) and Kim et al., *J. Immunol.* 24:249 (1994)).

"Human effector cells" are leukocytes which express one or more FcRs and perform effector functions. Preferably, the cells express at least FcγRIII and perform ADCC effector function. Examples of human leukocytes which mediate ADCC include peripheral blood mononuclear cells (PBMC), natural killer (NK) cells, monocytes, cytotoxic T cells and neutrophils; with PBMCs and NK cells being preferred. The effector cells may be isolated from a native source, e.g., from blood.

"Complement dependent cytotoxicity" or "CDC" refers to the lysis of a target cell in the presence of complement. Activation of the classical complement pathway is initiated by the binding of the first component of the complement system (C1q) to antibodies (of the appropriate subclass) which are bound to their cognate antigen. To assess complement activation, a CDC assay, e.g., as described in Gazzano-Santoro et al. *Immunol. Methods* 202:163 (1996), may be performed.

The terms "cancer" and "cancerous" refer to or describe the physiological condition in mammals that is typically characterized by unregulated cell growth. Examples of cancer include, but are not limited to, carcinoma, lymphoma, blastoma, sarcoma, and leukemia or lymphoid malignancies. More particular examples of such cancers include squamous cell cancer (e.g., epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer, pancreatic cancer, glioblastoma, cervical cancer, ovarian cancer, liver cancer, bladder cancer, cancer of the urinary tract, hepatoma, breast cancer, colon cancer, rectal cancer, colorectal cancer, endometrial or uterine carcinoma, salivary gland carcinoma, kidney or renal cancer, prostate cancer, vulval cancer, thyroid cancer, hepatic carcinoma, anal carcinoma, penile carcinoma, melanoma, multiple myeloma and B-cell lymphoma, brain, as well as head and neck cancer, and associated metastases. In a preferred embodiment of the present invention, the cancer is one of glial origin.

With reference to the terms "cancer", "cancerous", "tumor" and the like, the term "of glial origin" means that the cancerous cells or tumor cells derive from normal glial cells or tissue. Examples of cancer or tumor types that are "of glial origin" include, for example, astrocytoma (including grades I, II, III, and IV which may be designated as pilocytic astrocytoma, diffuse astrocytoma, anaplastic astrocytoma and/or glioblastoma multiforma), subependymal giant cell astrocytoma, pleomorphic xanthoastrocytoma, oligodendroglioma (including grades II and III which maybe designated as diffuse oligodendroglioma, malignant oligodendroglioma, or anaplastic oligodendroglioma), oligoastrocytoma (sometimes also referred to as mixed glioma), ependymoma, gliosarcoma, gliomatosis cerebri, and other tumors derived from glial cells which are known in the art.

The terms "cell proliferative disorder" and "proliferative disorder" refer to disorders that are associated with some degree of abnormal cell proliferation. In one embodiment, the cell proliferative disorder is cancer.

"Tumor", as used herein, refers to all neoplastic cell growth and proliferation, whether malignant or benign, and all pre-cancerous and cancerous cells and tissues.

An antibody, oligopeptide or other organic molecule which "induces cell death" is one which causes a viable cell to become nonviable. The cell is one which expresses a TAT polypeptide, preferably a cell that overexpresses a TAT polypeptide as compared to a normal cell of the same tissue type. The TAT polypeptide may be a transmembrane polypeptide expressed on the surface of a cancer cell or may be a polypeptide that is produced and secreted by a cancer cell. Preferably, the cell is a cancer cell, e.g., a breast, ovarian, stomach, endometrial, salivary gland, lung, kidney, colon, thyroid, pancreatic or bladder cell. Cell death in vitro may be determined in the absence of complement and immune effector cells to distinguish cell death induced by antibody-dependent cell-mediated cytotoxicity (ADCC) or complement dependent cytotoxicity (CDC). Thus, the assay for cell death may be performed using heat inactivated serum (i.e., in the absence of complement) and in the absence of immune effector cells. To determine whether the antibody, oligopeptide or other organic molecule is able to induce cell death, loss of membrane integrity as evaluated by uptake of propidium iodide (PI), trypan blue (see Moore et al. *Cytotechnology* 17:1-11 (1995)) or 7AAD can be assessed relative to untreated cells. Preferred cell death-inducing antibodies, oligopeptides or other organic molecules are those which induce PI uptake in the PI uptake assay in BT474 cells.

A "TAT-expressing cell" is a cell which expresses an endogenous or transfected TAT polypeptide either on the cell surface or in a secreted form. A "TAT-expressing cancer" is a cancer comprising cells that have a TAT polypeptide present on the cell surface or that produce and secrete a TAT polypeptide. A "TAT-expressing cancer" optionally produces sufficient levels of TAT polypeptide on the surface of cells thereof, such that an anti-TAT antibody, oligopeptide to other organic molecule can bind thereto and have a therapeutic effect with respect to the cancer. In another embodiment, a "TAT-expressing cancer" optionally produces and secretes sufficient levels of TAT polypeptide, such that an anti-TAT antibody, oligopeptide to other organic molecule antagonist can bind thereto and have a therapeutic effect with respect to the cancer. With regard to the latter, the antagonist may be an antisense oligonucleotide which reduces, inhibits or prevents production and secretion of the secreted TAT polypeptide by tumor cells. A cancer which "overexpresses" a TAT polypeptide is one which has significantly higher levels of TAT polypeptide at the cell surface thereof, or produces and secretes, compared to a noncancerous cell of the same tissue type. Such overexpression may be caused by gene amplification or by increased transcription or translation. TAT polypeptide overexpression may be determined in a diagnostic or prognostic assay by evaluating increased levels of the TAT protein present on the surface of a cell, or secreted by the cell (e.g., via an immunohistochemistry assay using anti-TAT antibodies prepared against an isolated TAT polypeptide which may be prepared using recombinant DNA technology from an isolated nucleic acid encoding the TAT polypeptide; FACS analysis, etc.). Alternatively, or additionally, one may measure levels of TAT polypeptide-encoding nucleic acid or mRNA in the cell, e.g., via fluorescent in situ hybridization using a nucleic acid based probe corresponding to a TAT-encoding nucleic acid or the complement thereof; (FISH; see WO98/45479 published October, 1998), Southern blotting, Northern blotting, or polymerase chain reaction (PCR) techniques, such as real time quantitative PCR (RT-PCR). One may also study TAT polypeptide overexpression by measuring shed antigen in a biological fluid such as serum, e.g, using antibody-based assays (see also, e.g., U.S. Pat. No. 4,933,294 issued Jun. 12, 1990; WO91/05264 published Apr. 18, 1991; U.S. Pat. No. 5,401,638 issued Mar. 28, 1995; and Sias et al., *J. Immunol. Methods* 132:73-80 (1990)). Aside from the above assays, various in vivo assays are available to the skilled practitioner. For example, one may expose cells within the body of the patient to an antibody which is optionally labeled with a detectable label, e.g., a radioactive isotope, and binding of the antibody to cells in the patient can be evaluated, e.g., by external scanning for radioactivity or by analyzing a biopsy taken from a patient previously exposed to the antibody.

As used herein, the term "immunoadhesin" designates antibody-like molecules which combine the binding specificity of a heterologous protein (an "adhesin") with the effector functions of immunoglobulin constant domains. Structurally, the immunoadhesins comprise a fusion of an amino acid sequence with the desired binding specificity which is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG-4 subtypes, IgA (including IgA-1 and IgA-2), IgE, IgD or IgM.

The word "label" when used herein refers to a detectable compound or composition which is conjugated directly or indirectly to the antibody, oligopeptide or other organic molecule so as to generate a "labeled" antibody, oligopeptide or other organic molecule. The label may be detectable by itself (e.g. radioisotope labels or fluorescent labels) or, in the case of an enzymatic label, may catalyze chemical alteration of a substrate compound or composition which is detectable.

The term "cytotoxic agent" as used herein refers to a substance that inhibits or prevents the function of cells and/or causes destruction of cells. The term is intended to include radioactive isotopes (e.g., $At^{211}$, $I^{131}$, $I^{125}$, $Y^{90}$, $Re^{186}$, $Re^{188}$, $Sm^{153}$, $Bi^{212}$, $P^{32}$ and radioactive isotopes of Lu), chemotherapeutic agents e.g. methotrexate, adriamicin, vinca alkaloids (vincristine, vinblastine, etoposide), doxorubicin, melphalan, mitomycin C, chlorambucil, daunorubicin or other intercalating agents, enzymes and fragments thereof such as nucleolytic enzymes, antibiotics, and toxins such as small molecule toxins or enzymatically active toxins of bacterial, fungal, plant or animal origin, including fragments and/or variants thereof, and the various antitumor or anticancer agents disclosed below. Other cytotoxic agents are described below. A tumoricidal agent causes destruction of tumor cells.

A "growth inhibitory agent" when used herein refers to a compound or composition which inhibits growth of a cell, especially a TAT-expressing cancer cell, either in vitro or in vivo. Thus, the growth inhibitory agent may be one which significantly reduces the percentage of TAT-expressing cells in S phase. Examples of growth inhibitory agents include agents that block cell cycle progression (at a place other than S phase), such as agents that induce G1 arrest and M-phase arrest. Classical M-phase blockers include the vincas (vincristine and vinblastine), taxanes, and topoisomerase II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in *The Molecular Basis of Cancer*, Mendelsohn and Israel, eds., Chapter 1, entitled "Cell cycle regulation, oncogenes, and antineoplastic drugs" by Murakami et al. (WB Saunders: Philadelphia, 1995), especially p. 13. The taxanes (paclitaxel and docetaxel) are anticancer drugs both derived from the yew tree. Docetaxel (TAXOTERE®, Rhone-Poulenc Rorer), derived from the European yew, is a semisynthetic analogue of paclitaxel (TAXOL®, Bristol-Myers Squibb). Paclitaxel and docetaxel promote the assembly of microtubules from tubulin dimers and stabilize microtubules by preventing depolymerization, which results in the inhibition of mitosis in cells. Growth inhibitory agents also include the family of auristatins.

"Doxorubicin" is an anthracycline antibiotic. The full chemical name of doxorubicin is (8S-cis)-10-[(3-amino-2,3,6-trideoxy-α-L-lyxo-hexapyranosyl)oxy]-7,8,9,10-tetrahydro-6,8,11-trihydroxy-8-(hydroxyacetyl)-1-methoxy-5,12-naphthacenedione.

The term "cytokine" is a generic term for proteins released by one cell population which act on another cell as intercellular mediators. Examples of such cytokines are lymphokines, monokines, and traditional polypeptide hormones. Included among the cytokines are growth hormone such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-α and -β; mullerian-inhibiting substance; mouse gonadotropin-associated peptide; inhibin; activin; vascular endothelial growth factor; integrin; thrombopoietin (TPO); nerve growth factors such as NGF-β; platelet-growth factor; transforming growth factors (TGFs) such as TGF-α and TGF-β; insulin-like growth factor-I and -II; erythropoietin (EPO); osteoinductive factors; interferons such as interferon-α, -β, and -γ; colony stimulating factors (CSFs) such as macrophage-CSF (M-CSF); granulocyte-macrophage-CSF (GM-CSF); and granulocyte-CSF (G-CSF); interleukins (ILs) such as IL-1, IL-1a, IL-2, IL-3, IL-4, IL-5, IL-6, IL-7, IL-8, IL-9, IL-11, IL-12; a tumor necrosis factor such as TNF-α or TNF-β; and other polypeptide factors including LIF and kit ligand (KL). As used herein, the term cytokine includes proteins from natural sources or from recombinant cell culture and biologically active equivalents of the native sequence cytokines.

The term "package insert" is used to refer to instructions customarily included in commercial packages of therapeutic products, that contain information about the indications, usage, dosage, administration, contraindications and/or warnings concerning the use of such therapeutic products.

TABLE 2

| | | |
|---|---|---|
| TAT | XXXXXXXXXXXXXXX | (Length = 15 amino acids) |
| Comparison Protein | XXXXXYYYYYYY | (Length = 12 amino acids) |

% amino acid sequence identity = (the number of identically matching amino acid residues between the two polypeptide sequences as determined by ALIGN-2) divided by (the total number of amino acid residues of the TAT polypeptide) = 5 divided by 15 = 33.3%

TABLE 3

| | | |
|---|---|---|
| TAT | XXXXXXXXXX | (Length = 10 amino acids) |
| Comparison Protein | XXXXXYYYYYYZZYZ | (Length = 15 amino acids) |

% amino acid sequence identity = (the number of identically matching amino acid residues between the two polypeptide sequences as determined by ALIGN-2) divided by (the total number of amino acid residues of the TAT polypeptide) = 5 divided by 10 = 50%

TABLE 4

| | | |
|---|---|---|
| TAT-DNA | NNNNNNNNNNNNNN | (Length = 14 nucleotides) |

TABLE 4-continued

| | | |
|---|---|---|
| Comparison DNA | NNNNNNLLLLLLLLLL | (Length = 16 nucleotides) |

% nucleic acid sequence identity = (the number of identically matching nucleotides between the two nucleic acid sequences as determined by ALIGN-2) divided by (the total number of nucleotides of the TAT-DNA nucleic acid sequence) = 6 divided by 14 = 42.9%

TABLE 5

| | | |
|---|---|---|
| TAT-DNA | NNNNNNNNNNNN | (Length = 12 nucleotides) |
| Comparison DNA | NNNNLLLVV | (Length = 9 nucleotides) |

% nucleic acid sequence identity = (the number of identically matching nucleotides between the two nucleic acid sequences as determined by ALIGN-2) divided by (the total number of nucleotides of the TAT-DNA nucleic acid sequence) = 4 divided by 12 = 33.3%

II. Compositions and Methods of the Invention

A. Anti-TAT Antibodies

In one embodiment, the present invention provides anti-TAT antibodies which may find use herein as therapeutic and/or diagnostic agents. Exemplary antibodies include polyclonal, monoclonal, humanized, bispecific, and heteroconjugate antibodies.

1. Polyclonal Antibodies

Polyclonal antibodies are preferably raised in animals by multiple subcutaneous (sc) or intraperitoneal (ip) injections of the relevant antigen and an adjuvant. It may be useful to conjugate the relevant antigen (especially when synthetic peptides are used) to a protein that is immunogenic in the species to be immunized. For example, the antigen can be conjugated to keyhole limpet hemocyanin (KLH), serum albumin, bovine thyroglobulin, or soybean trypsin inhibitor, using a bifunctional or derivatizing agent, e.g., maleimidobenzoyl sulfosuccinimide ester (conjugation through cysteine residues), N-hydroxysuccinimide (through lysine residues), glutaraldehyde, succinic anhydride, $SOCl_2$, or $R^1N{=}C{=}NR$, where R and $R^1$ are different alkyl groups.

Animals are immunized against the antigen, immunogenic conjugates, or derivatives by combining, e.g., 100 μg or 5 μg of the protein or conjugate (for rabbits or mice, respectively) with 3 volumes of Freund's complete adjuvant and injecting the solution intradermally at multiple sites. One month later, the animals are boosted with ⅕ to 1/10 the original amount of peptide or conjugate in Freund's complete adjuvant by subcutaneous injection at multiple sites. Seven to 14 days later, the animals are bled and the serum is assayed for antibody titer. Animals are boosted until the titer plateaus. Conjugates also can be made in recombinant cell culture as protein fusions. Also, aggregating agents such as alum are suitably used to enhance the immune response.

2. Monoclonal Antibodies

Monoclonal antibodies may be made using the hybridoma method first described by Kohler et al., *Nature,* 256:495 (1975), or may be made by recombinant DNA methods (U.S. Pat. No. 4,816,567).

In the hybridoma method, a mouse or other appropriate host animal, such as a hamster, is immunized as described above to elicit lymphocytes that produce or are capable of producing antibodies that will specifically bind to the protein used for immunization. Alternatively, lymphocytes may be immunized in vitro. After immunization, lymphocytes are isolated and then fused with a myeloma cell line using a suitable fusing agent, such as polyethylene glycol, to form a hybridoma cell (Goding, *Monoclonal Antibodies: Principles and Practice*, pp. 59-103 (Academic Press, 1986)).

The hybridoma cells thus prepared are seeded and grown in a suitable culture medium which medium preferably contains one or more substances that inhibit the growth or survival of the unfused, parental myeloma cells (also referred to as fusion partner). For example, if the parental myeloma cells lack the enzyme hypoxanthine guanine phosphoribosyl transferase (HGPRT or HPRT), the selective culture medium for the hybridomas typically will include hypoxanthine, aminopterin, and thymidine (HAT medium), which substances prevent the growth of HGPRT-deficient cells.

Preferred fusion partner myeloma cells are those that fuse efficiently, support stable high-level production of antibody by the selected antibody-producing cells, and are sensitive to a selective medium that selects against the unfused parental cells. Preferred myeloma cell lines are murine myeloma lines, such as those derived from MOPC-21 and MPC-11 mouse tumors available from the Salk Institute Cell Distribution Center, San Diego, Calif. USA, and SP-2 and derivatives e.g., X63-Ag8-653 cells available from the American Type Culture Collection, Manassas, Va., USA. Human myeloma and mouse-human heteromyeloma cell lines also have been described for the production of human monoclonal antibodies (Kozbor, *J. Immunol.,* 133:3001 (1984); and Brodeur et al., *Monoclonal Antibody Production Techniques and Applications*, pp. 51-63 (Marcel Dekker, Inc., New York, 1987)).

Culture medium which hybridoma cells are growing is assayed for production of monoclonal antibodies directed against the antigen. Preferably, the binding specificity of monoclonal antibodies produced by hybridoma cells is determined by immunoprecipitation or by an in vitro binding assay, such as radioimmunoassay (RIA) or enzyme-linked immunosorbent assay (ELISA).

The binding affinity of the monoclonal antibody can, for example, be determined by the Scatchard analysis described in Munson et al., *Anal. Biochem.,* 107:220 (1980).

Once hybridoma cells that produce antibodies of the desired specificity, affinity, and/or activity are identified, the clones may be subcloned by limiting dilution procedures and grown by standard methods (Goding, *Monoclonal Antibodies: Principles and Practice*, pp. 59-103 (Academic Press, 1986)). Suitable culture media for this purpose include, for example, D-MEM or RPMI-1640 medium. In addition, the hybridoma cells may be grown in vivo as ascites tumors in an animal e.g, by i.p. injection of the cells into mice.

The monoclonal antibodies secreted by the subclones are suitably separated from the culture medium, ascites fluid, or serum by conventional antibody purification procedures such as, for example, affinity chromatography (e.g., using protein A or protein G-Sepharose) or ion-exchange chromatography, hydroxylapatite chromatography, gel electrophoresis, dialysis, etc.

DNA encoding the monoclonal antibodies is readily isolated and sequenced using conventional procedures (e.g., by using oligonucleotide probes that are capable of binding specifically to genes encoding the heavy and light chains of murine antibodies). The hybridoma cells serve as a preferred source of such DNA. Once isolated, the DNA may be placed into expression vectors, which are then transfected into host cells such as *E. coli* cells, simian COS cells, Chinese Hamster Ovary (CHO) cells, or myeloma cells that do not otherwise produce antibody protein, to obtain the synthesis of monoclonal antibodies in the recombinant host cells. Review articles on recombinant expression in bacteria of DNA encoding the antibody include Skerra et al., *Curr. Opinion in Immunol.,* 5:256-262 (1993) and Plückthun, *Immunol. Revs.* 130: 151-188 (1992).

In a further embodiment, monoclonal antibodies or antibody fragments can be isolated from antibody phage libraries generated using the techniques described in McCafferty et al., *Nature,* 348:552-554 (1990). Clackson et al., *Nature,* 352: 624-628 (1991) and Marks et al., *J. Mol. Biol.,* 222:581-597 (1991) describe the isolation of murine and human antibodies, respectively, using phage libraries. Subsequent publications describe the production of high affinity (nM range) human antibodies by chain shuffling (Marks et al., *Bio/Technology,* 10:779-783 (1992)), as well as combinatorial infection and in vivo recombination as a strategy for constructing very large phage libraries (Waterhouse et al., *Nuc. Acids. Res.* 21:2265-2266 (1993)). Thus, these techniques are viable alternatives to traditional monoclonal antibody hybridoma techniques for isolation of monoclonal antibodies.

The DNA that encodes the antibody may be modified to produce chimeric or fusion antibody polypeptides, for example, by substituting human heavy chain and light chain constant domain ($C_H$ and $C_L$) sequences for the homologous murine sequences (U.S. Pat. No. 4,816,567; and Morrison, et al., *Proc. Natl Acad. Sci. USA,* 81:6851 (1984)), or by fusing the immunoglobulin coding sequence with all or part of the coding sequence for a non-immunoglobulin polypeptide (heterologous polypeptide). The non-immunoglobulin polypeptide sequences can substitute for the constant domains of an antibody, or they are substituted for the variable domains of one antigen-combining site of an antibody to create a chimeric bivalent antibody comprising one antigen-combining site having specificity for an antigen and another antigen-combining site having specificity for a different antigen.

3. Human and Humanized Antibodies

The anti-TAT antibodies of the invention may further comprise humanized antibodies or human antibodies. Humanized forms of non-human (e.g., murine) antibodies are chimeric immunoglobulins, immunoglobulin chains or fragments thereof (such as Fv, Fab, Fab', $F(ab')_2$ or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., *Nature,* 321:522-525 (1986); Riechmann et al., *Nature,* 332:323-329 (1988); and Presta, *Curr. Op. Struct. Biol.,* 2:593-596 (1992)].

Methods for humanizing non-human antibodies are well known in the art. Generally, a humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers [Jones et al., *Nature,* 321:522-525 (1986); Riechmann et al., *Nature,* 332:323-327 (1988); Verhoeyen et al., *Science,* 239:1534-1536 (1988)], by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

The choice of human variable domains, both light and heavy, to be used in making the humanized antibodies is very important to reduce antigenicity and HAMA response (human anti-mouse antibody) when the antibody is intended for human therapeutic use. According to the so-called "best-fit" method, the sequence of the variable domain of a rodent antibody is screened against the entire library of known human variable domain sequences. The human V domain sequence which is closest to that of the rodent is identified and the human framework region (FR) within it accepted for the humanized antibody (Sims et al., *J. Immunol.* 151:2296 (1993); Chothia et al., *J. Mol. Biol.,* 196:901 (1987)). Another method uses a particular framework region derived from the consensus sequence of all human antibodies of a particular subgroup of light or heavy chains. The same framework may be used for several different humanized antibodies (Carter et al., *Proc. Natl. Acad. Sci. USA,* 89:4285 (1992); Presta et al., *J. Immunol.* 151:2623 (1993)).

It is further important that antibodies be humanized with retention of high binding affinity for the antigen and other favorable biological properties. To achieve this goal, according to a preferred method, humanized antibodies are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the recipient and import sequences so that the desired antibody characteristic, such as increased affinity for the target antigen(s), is achieved. In general, the hypervariable region residues are directly and most substantially involved in influencing antigen binding.

Various forms of a humanized anti-TAT antibody are contemplated. For example, the humanized antibody may be an antibody fragment, such as a Fab, which is optionally conjugated with one or more cytotoxic agent(s) in order to generate an immunoconjugate. Alternatively, the humanized antibody may be an intact antibody, such as an intact IgG1 antibody.

As an alternative to humanization, human antibodies can be generated. For example, it is now possible to produce transgenic animals (e.g., mice) that are capable, upon immunization, of producing a full repertoire of human antibodies in the absence of endogenous immunoglobulin production. For example, it has been described that the homozygous deletion of the antibody heavy-chain joining region ($J_H$) gene in chimeric and germ-line mutant mice results in complete inhibition of endogenous antibody production. Transfer of the human germ-line immunoglobulin gene array into such germ-line mutant mice will result in the production of human antibodies upon antigen challenge. See, e.g., Jakobovits et al., *Proc. Natl. Acad. Sci. USA,* 90:2551 (1993); Jakobovits et al., *Nature,* 362:255-258 (1993); Bruggemann et al., *Year in Immuno.* 7:33 (1993); U.S. Pat. Nos. 5,545,806, 5,569,825, 5,591,669 (all of GenPharm); 5,545,807; and WO 97/17852.

Alternatively, phage display technology (McCafferty et al., *Nature* 348:552-553 [1990]) can be used to produce human antibodies and antibody fragments in vitro, from immunoglobulin variable (V) domain gene repertoires from unimmunized donors. According to this technique, antibody V domain genes are cloned in-frame into either a major or minor coat protein gene of a filamentous bacteriophage, such as M13 or fd, and displayed as functional antibody fragments on the surface of the phage particle. Because the filamentous particle contains a single-stranded DNA copy of the phage genome, selections based on the functional properties of the antibody also result in selection of the gene encoding the antibody exhibiting those properties. Thus, the phage mimics some of the properties of the B-cell. Phage display can be performed in a variety of formats, reviewed in, e.g., Johnson, Kevin S. and Chiswell, David J., *Current Opinion in Structural Biology* 3:564-571 (1993). Several sources of V-gene segments can be used for phage display. Clackson et al., *Nature,* 352:624-628 (1991) isolated a diverse array of anti-oxazolone antibodies from a small random combinatorial library of V genes derived from the spleens of immunized mice. A repertoire of V genes from unimmunized human donors can be constructed and antibodies to a diverse array of antigens (including self-antigens) can be isolated essentially following the techniques described by Marks et al., *J. Mol. Biol.* 222:581-597 (1991), or Griffith et al., *EMBO J.* 12:725-734 (1993). See, also, U.S. Pat. Nos. 5,565,332 and 5,573,905.

As discussed above, human antibodies may also be generated by in vitro activated B cells (see U.S. Pat. Nos. 5,567,610 and 5,229,275).

4. Antibody Fragments

In certain circumstances there are advantages of using antibody fragments, rather than whole antibodies. The smaller size of the fragments allows for rapid clearance, and may lead to improved access to solid tumors.

Various techniques have been developed for the production of antibody fragments. Traditionally, these fragments were derived via proteolytic digestion of intact antibodies (see, e.g., Morimoto et al., *Journal of Biochemical and Biophysical Methods* 24:107-117 (1992); and Brennan et al., *Science,* 229:81 (1985)). However, these fragments can now be produced directly by recombinant host cells. Fab, Fv and ScFv antibody fragments can all be expressed in and secreted from *E. coli*, thus allowing the facile production of large amounts of these fragments. Antibody fragments can be isolated from the antibody phage libraries discussed above. Alternatively, Fab'-SH fragments can be directly recovered from *E. coli* and chemically coupled to form $F(ab')_2$ fragments (Carter et al., *Bio/Technology* 10:163-167 (1992)). According to another approach, $F(ab')_2$ fragments can be isolated directly from recombinant host cell culture. Fab and $F(ab')_2$ fragment with increased in vivo half-life comprising a salvage receptor binding epitope residues are described in U.S. Pat. No. 5,869,046. Other techniques for the production of antibody fragments will be apparent to the skilled practitioner. In other embodiments, the antibody of choice is a single chain Fv fragment (scFv). See WO 93/16185; U.S. Pat. No. 5,571,894; and U.S. Pat. No. 5,587,458. Fv and sFv are the only species with intact combining sites that are devoid of constant regions; thus, they are suitable for reduced nonspecific binding during in vivo use. sFv fusion proteins may be constructed to yield fusion of an effector protein at either the amino or the carboxy terminus of an sFv. See *Antibody Engineering*, ed. Borrebaeck, supra. The antibody fragment may also be a "linear antibody", e.g., as described in U.S. Pat. No. 5,641,870 for example. Such linear antibody fragments may be monospecific or bispecific.

5. Bispecific Antibodies

Bispecific antibodies are antibodies that have binding specificities for at least two different epitopes. Exemplary bispecific antibodies may bind to two different epitopes of a TAT protein as described herein. Other such antibodies may combine a TAT binding site with a binding site for another protein. Alternatively, an anti-TAT arm may be combined with an arm which binds to a triggering molecule on a leukocyte such as a T-cell receptor molecule (e.g. CD3), or Fc receptors for IgG (FcγR), such as FcγRI (CD64), FcγRII (CD32) and FcγRIII (CD16), so as to focus and localize cellular defense mechanisms to the TAT-expressing cell. Bispecific antibodies may also be used to localize cytotoxic agents to cells which express TAT. These antibodies possess a TAT-binding arm and an arm which binds the cytotoxic agent (e.g., saporin, anti-interferon-α, vinca alkaloid, ricin A chain, methotrexate or radioactive isotope hapten). Bispecific antibodies can be prepared as full length antibodies or antibody fragments (e.g., $F(ab')_2$ bispecific antibodies).

WO 96/16673 describes a bispecific anti-ErbB2/anti-FcγRIII antibody and U.S. Pat. No. 5,837,234 discloses a bispecific anti-ErbB2/anti-FcγRI antibody. A bispecific anti-ErbB2/Fc a antibody is shown in WO98/02463. U.S. Pat. No. 5,821,337 teaches a bispecific anti-ErbB2/anti-CD3 antibody.

Methods for making bispecific antibodies are known in the art. Traditional production of full length bispecific antibodies is based on the co-expression of two immunoglobulin heavy chain-light chain pairs, where the two chains have different specificities (Millstein et al., *Nature* 305:537-539 (1983)). Because of the random assortment of immunoglobulin heavy and light chains, these hybridomas (quadromas) produce a potential mixture of 10 different antibody molecules, of which only one has the correct bispecific structure. Purification of the correct molecule, which is usually done by affinity chromatography steps, is rather cumbersome, and the product yields are low. Similar procedures are disclosed in WO 93/08829, and in Traunecker et al., *EMBO J.* 10:3655-3659 (1991).

According to a different approach, antibody variable domains with the desired binding specificities (antibody-antigen combining sites) are fused to immunoglobulin constant domain sequences. Preferably, the fusion is with an Ig heavy chain constant domain, comprising at least part of the hinge, $C_H2$, and $C_H3$ regions. It is preferred to have the first heavy-chain constant region ($C_H1$) containing the site necessary for light chain bonding, present in at least one of the fusions. DNAs encoding the immunoglobulin heavy chain fusions and, if desired, the immunoglobulin light chain, are inserted into separate expression vectors, and are co-transfected into a suitable host cell. This provides for greater flexibility in adjusting the mutual proportions of the three polypeptide fragments in embodiments when unequal ratios of the three polypeptide chains used in the construction provide the optimum yield of the desired bispecific antibody. It is, however, possible to insert the coding sequences for two or all three polypeptide chains into a single expression vector when the expression of at least two polypeptide chains in equal ratios results in high yields or when the ratios have no significant affect on the yield of the desired chain combination.

In a preferred embodiment of this approach, the bispecific antibodies are composed of a hybrid immunoglobulin heavy chain with a first binding specificity in one arm, and a hybrid immunoglobulin heavy chain-light chain pair (providing a second binding specificity) in the other arm. It was found that this asymmetric structure facilitates the separation of the desired bispecific compound from unwanted immunoglobulin chain combinations, as the presence of an immunoglobulin light chain in only one half of the bispecific molecule provides for a facile way of separation. This approach is disclosed in WO 94/04690. For further details of generating bispecific antibodies see, for example, Suresh et al., *Methods in Enzymology* 121:210 (1986).

According to another approach described in U.S. Pat. No. 5,731,168, the interface between a pair of antibody molecules can be engineered to maximize the percentage of heterodimers which are recovered from recombinant cell culture. The preferred interface comprises at least a part of the $C_H3$ domain. In this method, one or more small amino acid side chains from the interface of the first antibody molecule are replaced with larger side chains (e.g., tyrosine or tryptophan). Compensatory "cavities" of identical or similar size to the large side chain(s) are created on the interface of the second antibody molecule by replacing large amino acid side chains with smaller ones (e.g., alanine or threonine). This provides a mechanism for increasing the yield of the heterodimer over other unwanted end-products such as homodimers.

Bispecific antibodies include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676,980), and for treatment of HIV infection (WO 91/00360, WO 92/200373, and EP 03089). Heteroconjugate antibodies may be made using any convenient cross-linking methods. Suitable cross-linking agents are well known in the art, and are disclosed in U.S. Pat. No. 4,676,980, along with a number of cross-linking techniques.

Techniques for generating bispecific antibodies from antibody fragments have also been described in the literature. For example, bispecific antibodies can be prepared using chemical linkage. Brennan et al., *Science* 229:81 (1985) describe a procedure wherein intact antibodies are proteolytically cleaved to generate $F(ab')_2$ fragments. These fragments are reduced in the presence of the dithiol complexing agent, sodium arsenite, to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Recent progress has facilitated the direct recovery of Fab'-SH fragments from *E. coli*, which can be chemically coupled to form bispecific antibodies. Shalaby et al., *J. Exp. Med.* 175: 217-225 (1992) describe the production of a fully humanized bispecific antibody $F(ab')_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets. Various techniques for making and isolating bispecific antibody fragments directly from recombinant cell culture have also been described. For example, bispecific antibodies have been produced using leucine zippers. Kostelny et al., *J. Immunol.* 148(5):1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444-6448 (1993) has provided an alternative mechanism for making bispecific antibody fragments. The fragments comprise a $V_H$ connected to a $V_L$ by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See Gruber et al., *J. Immunol.,* 152:5368 (1994).

Antibodies with more than two valencies are contemplated. For example, trispecific antibodies can be prepared. Tutt et al., *J. Immunol.* 147:60 (1991).

6. Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells [U.S. Pat. No. 4,676,980], and for treatment of HIV infection [WO 91/00360; WO 92/200373; EP 03089]. It is contemplated that the antibodies may be prepared in vitro using known methods in synthetic protein chemistry, including those involving crosslinking agents. For example, immunotoxins may be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

7. Multivalent Antibodies

A multivalent antibody may be internalized (and/or catabolized) faster than a bivalent antibody by a cell expressing an antigen to which the antibodies bind. The antibodies of the present invention can be multivalent antibodies (which are other than of the IgM class) with three or more antigen binding sites (e.g. tetravalent antibodies), which can be readily produced by recombinant expression of nucleic acid encoding the polypeptide chains of the antibody. The multivalent antibody can comprise a dimerization domain and three or more antigen binding sites. The preferred dimerization domain comprises (or consists of) an Fc region or a hinge region. In this scenario, the antibody will comprise an Fc region and three or more antigen binding sites amino-terminal to the Fc region. The preferred multivalent antibody herein comprises (or consists of) three to about eight, but preferably four, antigen binding sites. The multivalent antibody comprises at least one polypeptide chain (and preferably two polypeptide chains), wherein the polypeptide chain(s) comprise two or more variable domains. For instance, the polypeptide chain(s) may comprise VD1-$(X1)_n$-VD2-$(X2)_n$-Fc, wherein VD1 is a first variable domain, VD2 is a second variable domain, Fc is one polypeptide chain of an Fc region, X1 and X2 represent an amino acid or polypeptide, and n is 0 or 1. For instance, the polypeptide chain(s) may comprise: VH-CH1-flexible linker-VH-CH1-Fc region chain; or VH-CH1-VH-CH1-Fc region chain. The multivalent antibody herein preferably further comprises at least two (and preferably four) light chain variable domain polypeptides. The multivalent antibody herein may, for instance, comprise from about two to about eight light chain variable domain polypeptides. The light chain variable domain polypeptides contemplated here comprise a light chain variable domain and, optionally, further comprise a CL domain.

8. Effector Function Engineering

It may be desirable to modify the antibody of the invention with respect to effector function, e.g., so as to enhance antigen-dependent cell-mediated cyotoxicity (ADCC) and/or complement dependent cytotoxicity (CDC) of the antibody. This may be achieved by introducing one or more amino acid substitutions in an Fc region of the antibody. Alternatively or additionally, cysteine residue(s) may be introduced in the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., *J. Exp Med.* 176:1191-1195 (1992) and Shopes, B. *J. Immunol.* 148:2918-2922 (1992). Homodimeric antibodies with enhanced anti-tumor activity may also be prepared using heterobifunctional cross-linkers as described in Wolff et al., *Cancer Research* 53:2560-2565 (1993). Alternatively, an antibody can be engineered which has dual Fc regions and may thereby have enhanced complement lysis and ADCC capabilities. See Stevenson et al., *Anti-Cancer Drug Design* 3:219-230 (1989). To increase the serum half life of the antibody, one may incorporate a salvage receptor binding epitope into the antibody (especially an antibody fragment) as described in U.S. Pat. No. 5,739,277, for example. As used herein, the term "salvage receptor binding epitope" refers to an epitope of the Fc region of an IgG molecule (e.g., $IgG_1$, $IgG_2$, $IgG_3$, or $IgG_4$) that is responsible for increasing the in vivo serum half-life of the IgG molecule.

9. Immunoconjugates

The invention also pertains to immunoconjugates comprising an antibody conjugated to a cytotoxic agent such as a chemotherapeutic agent, a growth inhibitory agent, a toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *momordica charantia* inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}Bi$, $^{131}I$, $^{131}In$, $^{90}Y$, and $^{186}Re$. Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as his (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science,* 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

Conjugates of an antibody and one or more small molecule toxins, such as a calicheamicin, maytansinoids, a trichothene, and CC1065, and the derivatives of these toxins that have toxin activity, are also contemplated herein.

Maytansine and Maytansinoids

In one preferred embodiment, an anti-TAT antibody (full length or fragments) of the invention is conjugated to one or more maytansinoid molecules.

Maytansinoids are mitototic inhibitors which act by inhibiting tubulin polymerization. Maytansine was first isolated from the east African shrub *Maytenus serrata* (U.S. Pat. No. 3,896,111). Subsequently, it was discovered that certain microbes also produce maytansinoids, such as maytansinol and C-3 maytansinol esters (U.S. Pat. No. 4,151,042). Synthetic maytansinol and derivatives and analogues thereof are disclosed, for example, in U.S. Pat. Nos. 4,137,230; 4,248,870; 4,256,746; 4,260,608; 4,265,814; 4,294,757; 4,307,016; 4,308,268; 4,308,269; 4,309,428; 4,313,946; 4,315,929; 4,317,821; 4,322,348; 4,331,598; 4,361,650; 4,364,866; 4,424,219; 4,450,254; 4,362,663; and 4,371,533, the disclosures of which are hereby expressly incorporated by reference.

Maytansinoid-Antibody Conjugates

In an attempt to improve their therapeutic index, maytansine and maytansinoids have been conjugated to antibodies specifically binding to tumor cell antigens. Immunoconjugates containing maytansinoids and their therapeutic use are disclosed, for example, in U.S. Pat. Nos. 5,208,020, 5,416,064 and European Patent EP 0 425 235 B1, the disclosures of which are hereby expressly incorporated by reference. Liu et al., *Proc. Natl. Acad. Sci. USA* 93:8618-8623 (1996) described immunoconjugates comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay. Chari et al., *Cancer Research* 52:127-131 (1992) describe immunoconjugates in which a maytansinoid was conjugated via a disulfide linker to the murine antibody A7 binding to an antigen on human colon cancer cell lines, or to another murine monoclonal antibody TA.1 that binds the HER-2/neu oncogene. The cytotoxicity of the TA.1-maytansonoid conjugate was tested in vitro on the human breast cancer cell line SK-BR-3, which expresses $3\times10^5$ HER-2 surface antigens per cell. The drug conjugate achieved a degree of cytotoxicity similar to the free maytansonid drug, which could be increased by increasing the number of maytansinoid molecules per antibody molecule. The A7-maytansinoid conjugate showed low systemic cytotoxicity in mice.

Anti-TAT Polypeptide Antibody-Maytansinoid Conjugates (Immunoconjugates)

Anti-TAT antibody-maytansinoid conjugates are prepared by chemically linking an anti-TAT antibody to a maytansinoid molecule without significantly diminishing the biological activity of either the antibody or the maytansinoid molecule. An average of 3-4 maytansinoid molecules conjugated per antibody molecule has shown efficacy in enhancing cytotoxicity of target cells without negatively affecting the function or solubility of the antibody, although even one molecule of toxin/antibody would be expected to enhance cytotoxicity over the use of naked antibody. Maytansinoids are well known in the art and can be synthesized by known techniques or isolated from natural sources. Suitable maytansinoids are disclosed, for example, in U.S. Pat. No. 5,208,020 and in the other patents and nonpatent publications referred to hereinabove. Preferred maytansinoids are maytansinol and maytansinol analogues modified in the aromatic ring or at other positions of the maytansinol molecule, such as various maytansinol esters.

There are many linking groups known in the art for making antibody-maytansinoid conjugates, including, for example, those disclosed in U.S. Pat. No. 5,208,020 or EP Patent 0 425 235 B1, and Chari et al., *Cancer Research* 52:127-131 (1992). The linking groups include disulfide groups, thioether groups, acid labile groups, photolabile groups, peptidase labile groups, or esterase labile groups, as disclosed in the above-identified patents, disulfide and thioether groups being preferred.

Conjugates of the antibody and maytansinoid may be made using a variety of bifunctional protein coupling agents such as N-succinimidyl-3-(2-pyridyldithio)propionate (SPDP), succinimidyl-4-(N-maleimidomethyl) cyclohexane-1-carboxylate, iminothiolane (IT), bifunctional derivatives of imidoesters (such as dimethyl adipimidate HCL), active esters (such as disuccinimidyl suberate), aldehydes (such as glutareldehyde), bis-azido compounds (such as bis(p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). Particularly preferred coupling agents include N-succinimidyl-3-(2-pyridyldithio)propionate (SPDP) (Carlsson et al., *Biochem. J.* 173:723-737 [1978]) and N-succinimidyl-4-(2-pyridylthio)pentanoate (SPP) to provide for a disulfide linkage.

The linker may be attached to the maytansinoid molecule at various positions, depending on the type of the link. For example, an ester linkage may be formed by reaction with a hydroxyl group using conventional coupling techniques. The reaction may occur at the C-3 position having a hydroxyl group, the C-14 position modified with hydroxymethyl, the C-15 position modified with a hydroxyl group, and the C-20 position having a hydroxyl group. In a preferred embodiment, the linkage is formed at the C-3 position of maytansinol or a maytansinol analogue.

Calicheamicin

Another immunoconjugate of interest comprises an anti-TAT antibody conjugated to one or more calicheamicin molecules. The calicheamicin family of antibiotics are capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296 (all to American Cyanamid Company). Structural analogues of calicheamicin which may be used include, but are not limited to, $\gamma_1^I$, $\alpha_2^I$, $\alpha_3^I$, N-acetyl-$\gamma_1^I$, PSAG and $\theta^I_1$ (Hinman et al., *Cancer Research* 53:3336-3342 (1993), Lode et al., *Cancer Research* 58:2925-2928 (1998) and the aforementioned U.S. patents to American Cyanamid). Another anti-tumor drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

Other Cytotoxic Agents

Other antitumor agents that can be conjugated to the anti-TAT antibodies of the invention include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof which can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *momordica charantia* inhibitor, curcin, crotin, sapaonaria officinalis inhibitor, gelonin, mitogellin, restrictocin, phenomycin, enomycin and the tricothecenes. See, for example, WO 93/21232 published Oct. 28, 1993.

The present invention further contemplates an immunoconjugate formed between an antibody and a compound with nucleolytic activity (e.g., a ribonuclease or a DNA endonuclease such as a deoxyribonuclease; DNase).

For selective destruction of the tumor, the antibody may comprise a highly radioactive atom. A variety of radioactive isotopes are available for the production of radioconjugated anti-TAT antibodies. Examples include $At^{211}$, $I^{131}$, $I^{125}$, $Y^{90}$, $Re^{186}$, $Re^{188}$, $Sm^{153}$, $Bi^{212}$, $P^{32}$, $Pb^{212}$ and radioactive isotopes of Lu. When the conjugate is used for diagnosis, it may comprise a radioactive atom for scintigraphic studies, for example $tc^{99m}$ or $I^{123}$, or a spin label for nuclear magnetic resonance (NMR) imaging (also known as magnetic resonance imaging, mri), such as iodine-123 again, iodine-131, indium-111, fluorine-19, carbon-13, nitrogen-15, oxygen-17, gadolinium, manganese or iron.

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as $tc^{99m}$or $I^{123}$, $Re^{186}$, $Re^{188}$ and $In^{111}$ can be attached via a cysteine residue in the peptide. Yttrium-90 can be attached via a lysine residue. The IODOGEN method (Fraker et al (1978) Biochem. Biophys. Res. Commun. 80: 49-57 can be used to incorporate iodine-123. "Monoclonal Antibodies in Immunoscintigraphy" (Chatal, CRC Press 1989) describes other methods in detail.

Conjugates of the antibody and cytotoxic agent may be made using a variety of bifunctional protein coupling agents such as N-succinimidyl-3-(2-pyridyldithio)propionate (SPDP), succinimidyl-4-(N-maleimidomethyl) cyclohexane-1-carboxylate, iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science* 238:1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., *Cancer Research* 52:127-131 (1992); U.S. Pat. No. 5,208,020) may be used.

Alternatively, a fusion protein comprising the anti-TAT antibody and cytotoxic agent may be made, e.g., by recombinant techniques or peptide synthesis. The length of DNA may comprise respective regions encoding the two portions of the conjugate either adjacent one another or separated by a region encoding a linker peptide which does not destroy the desired properties of the conjugate.

In yet another embodiment, the antibody may be conjugated to a "receptor" (such streptavidin) for utilization in tumor pre-targeting wherein the antibody-receptor conjugate is administered to the patient, followed by removal of unbound conjugate from the circulation using a clearing agent and then administration of a "ligand" (e.g., avidin) which is conjugated to a cytotoxic agent (e.g., a radionucleotide).

10. Immunoliposomes

The anti-TAT antibodies disclosed herein may also be formulated as immunoliposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody are prepared by methods known in the art, such as described in Epstein et al., *Proc. Natl. Acad. Sci. USA* 82:3688 (1985); Hwang et al., *Proc. Natl. Acad. Sci. USA* 77:4030 (1980); U.S. Pat. Nos. 4,485,045 and 4,544,545; and WO97/38731 published Oct. 23, 1997. Liposomes with enhanced circulation time are disclosed in U.S. Pat. No. 5,013,556.

Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.* 257: 286-288 (1982) via a disulfide interchange reaction. A chemotherapeutic agent is optionally contained within the liposome. See Gabizon et al., *J. National Cancer Inst.* 81(19): 1484 (1989).

B. TAT Binding Oligopeptides

TAT binding oligopeptides of the present invention are oligopeptides that bind, preferably specifically, to a TAT polypeptide as described herein. TAT binding oligopeptides may be chemically synthesized using known oligopeptide synthesis methodology or may be prepared and purified using recombinant technology. TAT binding oligopeptides are usually at least about 5 amino acids in length, alternatively at least about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 amino acids in length or more, wherein such oligopeptides that are capable of binding, preferably specifically, to a TAT polypeptide as described herein. TAT binding oligopeptides may be identified without undue experimentation using well known techniques. In this regard, it is noted that techniques for screening oligopeptide libraries for oligopeptides that are capable of specifically binding to a polypeptide target are well known in the art (see, e.g., U.S. Pat. Nos. 5,556,762, 5,750,373, 4,708, 871, 4,833,092, 5,223,409, 5,403,484, 5,571,689, 5,663,143; PCT Publication Nos. WO 84/03506 and WO84/03564; Geysen et al., Proc. Natl. Acad. Sci. U.S.A., 81:3998-4002(1984); Geysen et al., Proc. Natl. Acad. Sci. U.S.A., 82:178-182 (1985); Geysen et al., in Synthetic Peptides as Antigens, 130-149 (1986); Geysen et al., J. Immunol. Meth., 102:259-274 (1987); Schoofs et al., *J. Immunol.,* 140:611-616 (1988), Cwirla, S. E. et al. (1990) Proc. Natl. Acad. Sci. USA, 87:6378; Lowman, H. B. et al. (1991) Biochemistry, 30:10832; Clackson, T. et al. (1991) Nature, 352: 624; Marks, J. D. et al. (1991), J. Mol. Biol., 222:581; Kang, A. S. et al. (1991) Proc. Natl. Acad. Sci. USA, 88:8363, and Smith, G. P. (1991) Current Opin. Biotechnol., 2:668).

In this regard, bacteriophage (phage) display is one well known technique which allows one to screen large oligopeptide libraries to identify member(s) of those libraries which are capable of specifically binding to a polypeptide target. Phage display is a technique by which variant polypeptides are displayed as fusion proteins to the coat protein on the surface of bacteriophage particles (Scott, J. K. and Smith, G. P. (1990) Science 249: 386). The utility of phage display lies in the fact that large libraries of selectively randomized protein variants (or randomly cloned cDNAs) can be rapidly and efficiently sorted for those sequences that bind to a target molecule with high affinity. Display of peptide (Cwirla, S. E. et al. (1990) Proc. Natl. Acad. Sci. USA, 87:6378) or protein (Lowman, H. B. et al. (1991) Biochemistry, 30:10832; Clackson, T. et al. (1991) Nature, 352: 624; Marks, J. D. et al. (1991), J. Mol. Biol., 222:581; Kang, A. S. et al. (1991) Proc. Natl. Acad. Sci. USA, 88:8363) libraries on phage have been used for screening millions of polypeptides or oligopeptides for ones with specific binding properties (Smith, G. P. (1991) Current Opin. Biotechnol., 2:668). Sorting phage libraries of random mutants requires a strategy for constructing and propagating a large number of variants, a procedure for affinity purification using the target receptor, and a means of evaluating the results of binding enrichments. U.S. Pat. Nos. 5,223,409, 5,403,484, 5,571,689, and 5,663,143.

Although most phage display methods have used filamentous phage, lambdoid phage display systems (WO 95/34683; U.S. Pat. No. 5,627,024), T4 phage display systems (Ren, Z-J. et al. (1998) Gene 215:439; Zhu, Z. (1997) CAN 33:534; Jiang, J. et al. (1997) can 128:44380; Ren, Z-J. et al. (1997) CAN 127:215644; Ren, Z-J. (1996) Protein Sci. 5:1833; Efimov, V. P. et al. (1995) Virus Genes 10:173) and T7 phage display systems (Smith, G. P. and Scott, J. K. (1993) Methods in Enzymology, 217, 228-257; U.S. Pat. No. 5,766,905) are also known.

Many other improvements and variations of the basic phage display concept have now been developed. These improvements enhance the ability of display systems to screen peptide libraries for binding to selected target molecules and to display functional proteins with the potential of screening these proteins for desired properties. Combinatorial reaction devices for phage display reactions have been developed (WO 98/14277) and phage display libraries have been used to analyze and control bimolecular interactions (WO 98/20169; WO 98/20159) and properties of constrained helical peptides (WO 98/20036). WO 97/35196 describes a method of isolating an affinity ligand in which a phage display library is contacted with one solution in which the ligand will bind to a target molecule and a second solution in which the affinity ligand will not bind to the target molecule, to selectively isolate binding ligands. WO 97/46251 describes a method of biopanning a random phage display library with an affinity purified antibody and then isolating binding phage, followed by a micropanning process using microplate wells to isolate high affinity binding phage. The use of *Staphylococcus aureus* protein A as an affinity tag has also been reported (Li et al. (1998) Mol. Biotech., 9:187). WO 97/47314 describes the use of substrate subtraction libraries to distinguish enzyme specificities using a combinatorial library which may be a phage display library. A method for selecting enzymes suitable for use in detergents using phage display is described in WO 97/09446. Additional methods of selecting specific binding proteins are described in U.S. Pat. Nos. 5,498,538, 5,432,018, and WO 98/15833.

Methods of generating peptide libraries and screening these libraries are also disclosed in U.S. Pat. Nos. 5,723,286, 5,432,018, 5,580,717, 5,427,908, 5,498,530, 5,770,434, 5,734,018, 5,698,426, 5,763,192, and 5,723,323.

C. TAT Binding Organic Molecules

TAT binding organic molecules are organic molecules other than oligopeptides or antibodies as defined herein that bind, preferably specifically, to a TAT polypeptide as described herein. TAT binding organic molecules may be identified and chemically synthesized using known methodology (see, e.g., PCT Publication Nos. WO00/00823 and WO00/39585). TAT binding organic molecules are usually less than about 2000 daltons in size, alternatively less than about 1500, 750, 500, 250 or 200 daltons in size, wherein such organic molecules that are capable of binding, preferably specifically, to a TAT polypeptide as described herein may be identified without undue experimentation using well known techniques. In this regard, it is noted that techniques for screening organic molecule libraries for molecules that are capable of binding to a polypeptide target are well known in the art (see, e.g., PCT Publication Nos. WO00/00823 and WO00/39585). TAT binding organic molecules may be, for example, aldehydes, ketones, oximes, hydrazones, semicarbazones, carbazides, primary amines, secondary amines, tertiary amines, N-substituted hydrazines, hydrazides, alcohols, ethers, thiols, thioethers, disulfides, carboxylic acids, esters, amides, ureas, carbamates, carbonates, ketals, thioketals, acetals, thioacetals, aryl halides, aryl sulfonates, alkyl halides, alkyl sulfonates, aromatic compounds, heterocyclic compounds, anilines, alkenes, alkynes, diols, amino alcohols, oxazolidines, oxazolines, thiazolidines, thiazolines, enamines, sulfonamides, epoxides, aziridines, isocyanates, sulfonyl chlorides, diazo compounds, acid chlorides, or the like.

D. Screening for Anti-TAT Antibodies, TAT Binding Oligopeptides and TAT Binding Organic Molecules with the Desired Properties Techniques for generating antibodies, oligopeptides and organic molecules that bind to TAT polypeptides have been described above. One may further select antibodies, oligopeptides or other organic molecules with certain biological characteristics, as desired.

The growth inhibitory effects of an anti-TAT antibody, oligopeptide or other organic molecule of the invention may be assessed by methods known in the art, e.g., using cells which express a TAT polypeptide either endogenously or following transfection with the TAT gene. For example, appropriate tumor cell lines and TAT-transfected cells may treated with an anti-TAT monoclonal antibody, oligopeptide or other organic molecule of the invention at various concentrations for a few days (e.g., 2-7) days and stained with crystal violet or MTT or analyzed by some other colorimetric assay. Another method of measuring proliferation would be by comparing $^3$H-thymidine uptake by the cells treated in the presence or absence an anti-TAT antibody, TAT binding oligopeptide or TAT binding organic molecule of the invention. After treatment, the cells are harvested and the amount of radioactivity incorporated into the DNA quantitated in a scintillation counter. Appropriate positive controls include treatment of a selected cell line with a growth inhibitory antibody known to inhibit growth of that cell line. Growth inhibition of tumor cells in vivo can be determined in various ways known in the art. Preferably, the tumor cell is one that overexpresses a TAT polypeptide. Preferably, the anti-TAT antibody, TAT binding oligopeptide or TAT binding organic molecule will inhibit cell proliferation of a TAT-expressing tumor cell in vitro or in vivo by about 25-100% compared to the untreated tumor cell, more preferably, by about 30-100%, and even more preferably by about 50-100% or 70-100%, in one embodiment, at an antibody concentration of about 0.5 to 30 μg/ml. Growth inhibition can be measured at an antibody concentration of about 0.5 to 30 μg/ml or about 0.5 nM to 200 nM in cell culture, where the growth inhibition is determined 1-10 days after exposure of the tumor cells to the antibody. The antibody is growth inhibitory in vivo if administration of the anti-TAT antibody at about 1 μg/kg to about 100 mg/kg body weight results in reduction in tumor size or reduction of tumor cell proliferation within about 5 days to 3 months from the first administration of the antibody, preferably within about 5 to 30 days.

To select for an anti-TAT antibody, TAT binding oligopeptide or TAT binding organic molecule which induces cell death, loss of membrane integrity as indicated by, e.g., propidium iodide (PI), trypan blue or 7AAD uptake may be assessed relative to control. A PI uptake assay can be performed in the absence of complement and immune effector cells. TAT polypeptide-expressing tumor cells are incubated with medium alone or medium containing the appropriate anti-TAT antibody (e.g, at about 10 μg/ml), TAT binding oligopeptide or TAT binding organic molecule. The cells are incubated for a 3 day time period. Following each treatment, cells are washed and aliquoted into 35 mm strainer-capped 12×75 tubes (1 ml per tube, 3 tubes per treatment group) for removal of cell clumps. Tubes then receive PI (10 μg/ml). Samples may be analyzed using a FACSCAN® flow cytometer and FACSCONVERT® CellQuest software (Becton Dickinson). Those anti-TAT antibodies, TAT binding oligopeptides or TAT binding organic molecules that induce statistically significant levels of cell death as determined by PI uptake may be selected as cell death-inducing anti-TAT antibodies, TAT binding oligopeptides or TAT binding organic molecules.

To screen for antibodies, oligopeptides or other organic molecules which bind to an epitope on a TAT polypeptide bound by an antibody of interest, a routine cross-blocking assay such as that described in *Antibodies, A Laboratory Manual*, Cold Spring Harbor Laboratory, Ed Harlow and David Lane (1988), can be performed. This assay can be used to determine if a test antibody, oligopeptide or other organic molecule binds the same site or epitope as a known anti-TAT antibody. Alternatively, or additionally, epitope mapping can be performed by methods known in the art. For example, the antibody sequence can be mutagenized such as by alanine scanning, to identify contact residues. The mutant antibody is initially tested for binding with polyclonal antibody to ensure proper folding. In a different method, peptides corresponding to different regions of a TAT polypeptide can be used in competition assays with the test antibodies or with a test antibody and an antibody with a characterized or known epitope.

E. Antibody Dependent Enzyme Mediated Prodrug Therapy (ADEPT)

The antibodies of the present invention may also be used in ADEPT by conjugating the antibody to a prodrug-activating enzyme which converts a prodrug (e.g., a peptidyl chemotherapeutic agent, see WO81/01145) to an active anti-cancer drug. See, for example, WO 88/07378 and U.S. Pat. No. 4,975,278.

The enzyme component of the immunoconjugate useful for ADEPT includes any enzyme capable of acting on a prodrug in such a way so as to covert it into its more active, cytotoxic form.

Enzymes that are useful in the method of this invention include, but are not limited to, alkaline phosphatase useful for converting phosphate-containing prodrugs into free drugs; arylsulfatase useful for converting sulfate-containing prodrugs into free drugs; cytosine deaminase useful for converting non-toxic 5-fluorocytosine into the anti-cancer drug, 5-fluorouracil; proteases, such as *serratia* protease, thermolysin, subtilisin, carboxypeptidases and cathepsins (such as cathepsins B and L), that are useful for converting peptide-containing prodrugs into free drugs; D-alanylcarboxypeptidases, useful for converting prodrugs that contain D-amino acid substituents; carbohydrate-cleaving enzymes such as β-galactosidase and neuraminidase useful for converting glycosylated prodrugs into free drugs; β-lactamase useful for converting drugs derivatized with β-lactams into free drugs; and penicillin amidases, such as penicillin V amidase or penicillin G amidase, useful for converting drugs derivatized at their amine nitrogens with phenoxyacetyl or phenylacetyl groups, respectively, into free drugs. Alternatively, antibodies with enzymatic activity, also known in the art as "abzymes", can be used to convert the prodrugs of the invention into free active drugs (see, e.g., Massey, *Nature* 328:457-458 (1987)). Antibody-abzyme conjugates can be prepared as described herein for delivery of the abzyme to a tumor cell population.

The enzymes of this invention can be covalently bound to the anti-TAT antibodies by techniques well known in the art such as the use of the heterobifunctional crosslinking reagents discussed above. Alternatively, fusion proteins comprising at least the antigen binding region of an antibody of the invention linked to at least a functionally active portion of an enzyme of the invention can be constructed using recombinant DNA techniques well known in the art (see, e.g., Neuberger et al., *Nature* 312:604-608 (1984).

F. Full-Length TAT Polypeptides

The present invention also provides newly identified and isolated nucleotide sequences encoding polypeptides referred to in the present application as TAT polypeptides. In particular, cDNAs (partial and full-length) encoding various TAT polypeptides have been identified and isolated, as disclosed in further detail in the Examples below.

As disclosed in the Examples below, various cDNA clones have been deposited with the ATCC. The actual nucleotide sequences of those clones can readily be determined by the skilled artisan by sequencing of the deposited clone using routine methods in the art. The predicted amino acid sequence can be determined from the nucleotide sequence using routine skill. For the TAT polypeptides and encoding nucleic acids described herein, in some cases, Applicants have identified what is believed to be the reading frame best identifiable with the sequence information available at the time.

G. Anti-TAT Antibody and TAT Polypeptide Variants

In addition to the anti-TAT antibodies and full-length native sequence TAT polypeptides described herein, it is contemplated that anti-TAT antibody and TAT polypeptide variants can be prepared. Anti-TAT antibody and TAT polypeptide variants can be prepared by introducing appropriate nucleotide changes into the encoding DNA, and/or by synthesis of the desired antibody or polypeptide. Those skilled in the art will appreciate that amino acid changes may alter post-translational processes of the anti-TAT antibody or TAT polypeptide, such as changing the number or position of glycosylation sites or altering the membrane anchoring characteristics.

Variations in the anti-TAT antibodies and TAT polypeptides described herein, can be made, for example, using any of the techniques and guidelines for conservative and non-conservative mutations set forth, for instance, in U.S. Pat. No. 5,364,934. Variations may be a substitution, deletion or insertion of one or more codons encoding the antibody or polypeptide that results in a change in the amino acid sequence as compared with the native sequence antibody or polypeptide. Optionally the variation is by substitution of at least one amino acid with any other amino acid in one or more of the domains of the anti-TAT antibody or TAT polypeptide. Guidance in determining which amino acid residue may be inserted, substituted or deleted without adversely affecting the desired activity may be found by comparing the sequence of the anti-TAT antibody or TAT polypeptide with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

Anti-TAT antibody and TAT polypeptide fragments are provided herein. Such fragments may be truncated at the N-terminus or C-terminus, or may lack internal residues, for example, when compared with a full length native antibody or protein. Certain fragments lack amino acid residues that are not essential for a desired biological activity of the anti-TAT antibody or TAT polypeptide.

Anti-TAT antibody and TAT polypeptide fragments may be prepared by any of a number of conventional techniques. Desired peptide fragments may be chemically synthesized. An alternative approach involves generating antibody or polypeptide fragments by enzymatic digestion, e.g., by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired antibody or polypeptide fragment, by polymerase chain reaction (PCR). Oligonucleotides that define the desired termini of the DNA fragment are employed at the 5' and 3' primers in the PCR. Preferably, anti-TAT antibody and TAT polypeptide fragments share at least one biological and/or immunological activity with the native anti-TAT antibody or TAT polypeptide disclosed herein.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |

TABLE 6-continued

| Original Residue | Exemplary Substitutions | Preferred Substitutions |
|---|---|---|
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the anti-TAT antibody or TAT polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

(1) hydrophobic: norleucine, met, ala, val, leu, ile;
(2) neutral hydrophilic: cys, ser, thr;
(3) acidic: asp, glu;
(4) basic: asn, gln, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.,* 13:4331 (1986); Zoller et al., *Nucl. Acids Res.,* 10:6487 (1987)], cassette mutagenesis [Wells et al., *Gene,* 34:315 (1985)], restriction selection mutagenesis [Wells et al., *Philos. Trans. R. Soc. London SerA,* 317:415 (1986)] or other known techniques can be performed on the cloned DNA to produce the anti-TAT antibody or TAT polypeptide variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science,* 244:1081-1085 (1989)]. Alanine is also typically preferred because it is the most common amino acid. Further, it is frequently found in both buried and exposed positions [Creighton, *The Proteins*, (W.H. Freeman & Co., N.Y.); Chothia, *J. Mol. Biol.,* 150:1 (1976)]. If alanine substitution does not yield adequate amounts of variant, an isoteric amino acid can be used.

Any cysteine residue not involved in maintaining the proper conformation of the anti-TAT antibody or TAT polypeptide also may be substituted, generally with serine, to improve the oxidative stability of the molecule and prevent aberrant crosslinking. Conversely, cysteine bond(s) may be added to the anti-TAT antibody or TAT polypeptide to improve its stability (particularly where the antibody is an antibody fragment such as an Fv fragment).

A particularly preferred type of substitutional variant involves substituting one or more hypervariable region residues of a parent antibody (e.g., a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e.g., 6-7 sites) are mutated to generate all possible amino substitutions at each site. The antibody variants thus generated are displayed in a monovalent fashion from filamentous phage particles as fusions to the gene III product of M13 packaged within each particle. The phage-displayed variants are then screened for their biological activity (e.g., binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the antibody and human TAT polypeptide. Such contact residues and neighboring residues are candidates for substitution according to the techniques elaborated herein. Once such variants are generated, the panel of variants is subjected to screening as described herein and antibodies with superior properties in one or more relevant assays may be selected for further development.

Nucleic acid molecules encoding amino acid sequence variants of the anti-TAT antibody are prepared by a variety of methods known in the art. These methods include, but are not limited to, isolation from a natural source (in the case of naturally occurring amino acid sequence variants) or preparation by oligonucleotide-mediated (or site-directed) mutagenesis, PCR mutagenesis, and cassette mutagenesis of an earlier prepared variant or a non-variant version of the anti-TAT antibody.

H. Modifications of Anti-TAT Antibodies and TAT Polypeptides

Covalent modifications of anti-TAT antibodies and TAT polypeptides are included within the scope of this invention. One type of covalent modification includes reacting targeted amino acid residues of an anti-TAT antibody or TAT polypeptide with an organic derivatizing agent that is capable of reacting with selected side chains or the N- or C-terminal residues of the anti-TAT antibody or TAT polypeptide. Derivatization with bifunctional agents is useful, for instance, for crosslinking anti-TAT antibody or TAT polypeptide to a water-insoluble support matrix or surface for use in the method for purifying anti-TAT antibodies, and vice-versa. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the α-amino groups of lysine, arginine, and histidine side chains [T. E. Creighton, *Proteins: Structure and Molecular Properties*, W.H. Freeman & Co., San Francisco, pp. 79-86 (1983)], acetylation of the N-terminal amine, and amidation of any C-terminal carboxyl group.

Another type of covalent modification of the anti-TAT antibody or TAT polypeptide included within the scope of this invention comprises altering the native glycosylation pattern of the antibody or polypeptide. "Altering the native glycosylation pattern" is intended for purposes herein to mean deleting one or more carbohydrate moieties found in native sequence anti-TAT antibody or TAT polypeptide (either by removing the underlying glycosylation site or by deleting the glycosylation by chemical and/or enzymatic means), and/or adding one or more glycosylation sites that are not present in the native sequence anti-TAT antibody or TAT polypeptide. In addition, the phrase includes qualitative changes in the glycosylation of the native proteins, involving a change in the nature and proportions of the various carbohydrate moieties present.

Glycosylation of antibodies and other polypeptides is typically either N-linked or O-linked. N-linked refers to the attachment of the carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-aceylgalactosamine, galactose, or xylose to a hydroxyamino acid, most commonly serine or threonine, although 5-hydroxyproline or 5-hydroxylysine may also be used.

Addition of glycosylation sites to the anti-TAT antibody or TAT polypeptide is conveniently accomplished by altering the amino acid sequence such that it contains one or more of the above-described tripeptide sequences (for N-linked glycosylation sites). The alteration may also be made by the addition of, or substitution by, one or more serine or threonine residues to the sequence of the original anti-TAT antibody or TAT polypeptide (for O-linked glycosylation sites). The anti-TAT antibody or TAT polypeptide amino acid sequence may optionally be altered through changes at the DNA level, particularly by mutating the DNA encoding the anti-TAT antibody or TAT polypeptide at preselected bases such that codons are generated that will translate into the desired amino acids.

Another means of increasing the number of carbohydrate moieties on the anti-TAT antibody or TAT polypeptide is by chemical or enzymatic coupling of glycosides to the polypeptide. Such methods are described in the art, e.g., in WO 87/05330 published 11 Sep. 1987, and in Aplin and Wriston, *CRC Crit. Rev. Biochem*., pp. 259-306 (1981).

Removal of carbohydrate moieties present on the anti-TAT antibody or TAT polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., *Arch. Biochem. Biophys.,* 259:52 (1987) and by Edge et al., *Anal. Biochem.,* 118:131 (1981). Enzymatic cleavage of carbohydrate moieties on polypeptides can be achieved by the use of a variety of endo- and exo-glycosidases as described by Thotakura et al., *Meth. Enzymol.,* 138:350 (1987).

Another type of covalent modification of anti-TAT antibody or TAT polypeptide comprises linking the antibody or polypeptide to one of a variety of nonproteinaceous polymers, e.g., polyethylene glycol (PEG), polypropylene glycol, or polyoxyalkylenes, in the manner set forth in U.S. Pat. No. 4,640,835; 4,496,689; 4,301,144; 4,670,417; 4,791,192 or 4,179,337. The antibody or polypeptide also may be entrapped in microcapsules prepared, for example, by coacervation techniques or by interfacial polymerization (for example, hydroxymethylcellulose or gelatin-microcapsules and poly-(methylmethacylate) microcapsules, respectively), in colloidal drug delivery systems (for example, liposomes, albumin microspheres, microemulsions, nano-particles and nanocapsules), or in macroemulsions. Such techniques are disclosed in Remington's Pharmaceutical Sciences, 16th edition, Oslo, A., Ed., (1980).

The anti-TAT antibody or TAT polypeptide of the present invention may also be modified in a way to form chimeric molecules comprising an anti-TAT antibody or TAT polypeptide fused to another, heterologous polypeptide or amino acid sequence.

In one embodiment, such a chimeric molecule comprises a fusion of the anti-TAT antibody or TAT polypeptide with a tag polypeptide which provides an epitope to which an anti-tag antibody can selectively bind. The epitope tag is generally placed at the amino- or carboxyl-terminus of the anti-TAT antibody or TAT polypeptide. The presence of such epitope-tagged forms of the anti-TAT antibody or TAT polypeptide can be detected using an antibody against the tag polypeptide. Also, provision of the epitope tag enables the anti-TAT antibody or TAT polypeptide to be readily purified by affinity purification using an anti-tag antibody or another type of affinity matrix that binds to the epitope tag. Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., *Mol. Cell. Biol.,* 8:2159-2165 (1988)]; the c-myc tag and the 8F9, 3C7, 6E10, G4, B7 and 9E10 antibodies thereto [Evan et al., *Molecular and Cellular Biology*, 5:3610-3616 (1985)]; and the Herpes Simplex virus glycoprotein D (gD) tag and its antibody [Paborsky et al., *Protein Engineering,* 3(6):547-553 (1990)]. Other tag polypeptides include the Flag-peptide [Hopp et a *BioTechnology,* 6:1204-1210 (1988)]; the KT3 epitope peptide [Martin et al., *Science,* 255:192-194 (1992)]; an α-tubulin epitope peptide [Skinner et al., *J. Biol. Chem.,* 266:15163-15166 (1991)]; and the T7 gene 10 protein peptide tag [Lutz-Freyermuth et al., *Proc. Natl. Acad. Sci. USA,* 87:6393-6397 (1990)].

In an alternative embodiment, the chimeric molecule may comprise a fusion of the anti-TAT antibody or TAT polypeptide with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of an anti-TAT antibody or TAT polypeptide in place of at least one variable region within an Ig molecule. In a particularly preferred embodiment, the immunoglobulin fusion includes the hinge, $CH_2$ and $CH_3$, or the hinge, $CH_1$, $CH_2$ and $CH_3$ regions of an IgG1 molecule. For the production of immunoglobulin fusions see also U.S. Pat. No. 5,428,130 issued Jun. 27, 1995.

I. Preparation of Anti-TAT Antibodies and TAT Polypeptides

The description below relates primarily to production of anti-TAT antibodies and TAT polypeptides by culturing cells transformed or transfected with a vector containing anti-TAT antibody- and TAT polypeptide-encoding nucleic acid. It is, of course, contemplated that alternative methods, which are well known in the art, may be employed to prepare anti-TAT antibodies and TAT polypeptides. For instance, the appropriate amino acid sequence, or portions thereof, may be produced by direct peptide synthesis using solid-phase techniques [see, e.g., Stewart et al., *Solid-Phase Peptide Synthesis*, W.H. Freeman Co., San Francisco, Calif. (1969); Merrifield, *J. Am. Chem. Soc.,* 85:2149-2154 (1963)]. In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the anti-TAT antibody or TAT polypeptide may be chemically synthesized separately and combined using chemical or enzymatic methods to produce the desired anti-TAT antibody or TAT polypeptide.

1. Isolation of DNA Encoding Anti-TAT Antibody or TAT Polypeptide

DNA encoding anti-TAT antibody or TAT polypeptide may be obtained from a cDNA library prepared from tissue believed to possess the anti-TAT antibody or TAT polypeptide mRNA and to express it at a detectable level. Accordingly, human anti-TAT antibody or TAT polypeptide DNA can be conveniently obtained from a cDNA library prepared from human tissue. The anti-TAT antibody- or TAT polypeptide-encoding gene may also be obtained from a genomic library or by known synthetic procedures (e.g., automated nucleic acid synthesis).

Libraries can be screened with probes (such as oligonucleotides of at least about 20-80 bases) designed to identify the gene of interest or the protein encoded by it. Screening the cDNA or genomic library with the selected probe may be conducted using standard procedures, such as described in Sambrook et al., *Molecular Cloning: A Laboratory Manual* (New York: Cold Spring Harbor Laboratory Press, 1989). An alternative means to isolate the gene encoding anti-TAT antibody or TAT polypeptide is to use PCR methodology [Sambrook et al., supra; Dieffenbach et al., *PCR Primer: A Laboratory Manual* (Cold Spring Harbor Laboratory Press, 1995)].

Techniques for screening a cDNA library are well known in the art. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radio labels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for anti-TAT antibody or TAT polypeptide production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in *Mammalian Cell Biotechnology: a Practical Approach*, M. Butler, ed. (IRL Press, 1991) and Sambrook et al., supra.

Methods of eukaryotic cell transfection and prokaryotic cell transformation are known to the ordinarily skilled artisan, for example, $CaCl_2$, $CaPO_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., *Gene,* 23:315 (1983) and WO 89/05859 published 29 Jun. 1989. For mammalian cells without such cell walls, the calcium phosphate precipitation method of Graham and van der Eb, *Virology,* 52:456-457 (1978) can be employed. General aspects of mammalian cell host system transfections have been described in U.S. Pat. No. 4,399,216. Transformations into yeast are typically carried out according to the method of Van Solingen et al., *J. Bact.,* 130:946 (1977) and Hsiao et al., *Proc. Natl. Acad. Sci. (USA)*, 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., *Methods in Enzymology,* 185:527-537 (1990) and Mansour et al., *Nature,* 336:348-352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27,325) and K5 772 (ATCC 53,635). Other suitable prokaryotic host cells include Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as Bacilli such as *B. subtilis* and *B. licheniformis* (e.g., *B. licheniformis* 41P disclosed in DD 266,710 published 12 Apr. 1989), *Pseudomonas* such as *P. aeruginosa*, and *Streptomyces*. These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3, *E. coli*

W3110 strain 27C7 (ATCC 55,244), which has the complete genotype tonA ptr3 phoA E15 (argF-lac)169 degP ompT kan, *E. coli* W3110 strain 37D6, which has the complete genotype tonA ptr3 phoA E15 (argF-lac)169 degP ompT rbs7 ilvG kan, *E. coli* W3110 strain 40B4, which is strain 37D6 with a non-kanamycin resistant degP deletion mutation; and an *E. coli* strain having mutant periplasmic protease disclosed in U.S. Pat. No. 4,946,783 issued 7 Aug. 1990. Alternatively, in vitro methods of cloning, e.g., PCR or other nucleic acid polymerase reactions, are suitable.

Full length antibody, antibody fragments, and antibody fusion proteins can be produced in bacteria, in particular when glycosylation and Fc effector function are not needed, such as when the therapeutic antibody is conjugated to a cytotoxic agent (e.g., a toxin) and the immunoconjugate by itself shows effectiveness in tumor cell destruction. Full length antibodies have greater half life in circulation. Production in *E. coli* is faster and more cost efficient. For expression of antibody fragments and polypeptides in bacteria, see, e.g., U.S. Pat. No. 5,648,237 (Carter et. al.), U.S. Pat. No. 5,789,199 (Joly et al.), and U.S. Pat. No. 5,840,523 (Simmons et al.) which describes translation initiation regio (TIR) and signal sequences for optimizing expression and secretion, these patents incorporated herein by reference. After expression, the antibody is isolated from the *E. coli* cell paste in a soluble fraction and can be purified through, e.g., a protein A or G column depending on the isotype. Final purification can be carried out similar to the process for purifying antibody expressed e.g, in CHO cells.

In addition to prokaryotes, eukaryotic microbes such as filamentous fungi or yeast are suitable cloning or expression hosts for anti-TAT antibody- or TAT polypeptide-encoding vectors. *Saccharomyces cerevisiae* is a commonly used lower eukaryotic host microorganism. Others include *Schizosaccharomyces pombe* (Beach and Nurse, *Nature,* 290: 140 [1981]; EP 139,383 published 2 May 1985); *Kluyveromyces* hosts (U.S. Pat. No. 4,943,529; Fleer et al., *Bio/Technology,* 9:968-975(1991)) such as, e.g., *K. lactis* (MW98-8C, CBS683, CBS4574; Louvencourt et al., *J. Bacteriol.,* 154(2): 737-742 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., *Bio/Technology,* 8:135 (1990)), *K. thermotolerans*, and *K. marxianus; yarrowia* (EP 402,226); *Pichia pastoris* (EP 183,070; Sreekrishna et al., *J. Basic Microbiol.,* 28:265-278 [1988]); *Candida; Trichoderma reesia* (EP 244,234); *Neurospora crassa* (Case et al., *Proc. Natl. Acad. Sci. USA,* 76:5259-5263 [1979]); *Schwanniomyces* such as *Schwanniomyces occidentalis* (EP 394,538 published 31 Oct. 1990); and filamentous fungi such as, e.g., *Neurospora, Penicillium, Tolypocladium* (WO 91/00357 published 10 Jan. 1991), and *Aspergillus* hosts such as *A. nidulans* (Ballance et al., *Biochem. Biophys. Res. Commun.,* 112:284-289 [1983]; Tilburn et al., *Gene,* 26:205-221 [1983]; Yelton et al., *Proc. Natl. Acad. Sci. USA,* 81: 1470-1474 [1984]) and *A. niger* (Kelly and Hynes, *EMBO J.,* 4:475-479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis*, and *Rhodotorula*. A list of specific species that are exemplary of this class of yeasts may be found in C. Anthony, *The Biochemistry of Methylotrophs,* 269 (1982).

Suitable host cells for the expression of glycosylated anti-TAT antibody or TAT polypeptide are derived from multicellular organisms. Examples of invertebrate cells include insect cells such as *Drosophila* S2 and *Spodoptera* Sf9, as well as plant cells, such as cell cultures of cotton, corn, potato, soybean, petunia, tomato, and tobacco. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruitfly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., *J. Gen Virol.* 36:59 (1977)); baby hamster kidney cells (BHK, ATCC CCL 10); Chinese hamster ovary cells/–DHFR (CHO, Urlaub et al., *Proc. Natl. Acad. Sci. USA* 77:4216 (1980)); mouse sertoli cells (TM4, Mather, *Biol. Reprod.* 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL 51); TRI cells (Mather et al., *Annals N.Y. Acad. Sci.* 383:44-68 (1982)); MRC 5 cells; FS4 cells; and a human hepatoma line (Hep G2).

Host cells are transformed with the above-described expression or cloning vectors for anti-TAT antibody or TAT polypeptide production and cultured in conventional nutrient media modified as appropriate for inducing promoters, selecting transformants, or amplifying the genes encoding the desired sequences.

3. Selection and Use of a Replicable Vector

The nucleic acid (e.g., cDNA or genomic DNA) encoding anti-TAT antibody or TAT polypeptide may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The TAT may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the anti-TAT antibody- or TAT polypeptide-encoding DNA that is inserted into the vector. The signal sequence may be a prokaryotic signal sequence selected, for example, from the group of the alkaline phosphatase, penicillinase, lpp, or heat-stable enterotoxin II leaders. For yeast secretion the signal sequence may be, e.g., the yeast invertase leader, alpha factor leader (including *Saccharomyces* and *Kluyveromyces* α-factor leaders, the latter described in U.S. Pat. No. 5,010,182), or acid phosphatase leader, the *C. albicans* glucoamylase leader (EP 362,179 published 4 Apr. 1990), or the signal described in WO 90/13646 published 15 Nov. 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

An example of suitable selectable markers for mammalian cells are those that enable the identification of cells competent to take up the anti-TAT antibody- or TAT polypeptide-encoding nucleic acid, such as DHFR or thymidine kinase. An appropriate host cell when wild-type DHFR is employed is the CHO cell line deficient in DHFR activity, prepared and propagated as described by Urlaub et al., *Proc. Natl. Acad. Sci. USA,* 77:4216 (1980). A suitable selection gene for use in yeast is the trp1 gene present in the yeast plasmid YRp7 [Stinchcomb et al., *Nature,* 282:39 (1979); Kingsman et al., *Gene,* 7:141 (1979); Tschemper et al., *Gene,* 10:157 (1980)]. The trp1 gene provides a selection marker for a mutant strain of yeast lacking the ability to grow in tryptophan, for example, ATCC No. 44076 or PEP4-1 [Jones, *Genetics,* 85:12 (1977)].

Expression and cloning vectors usually contain a promoter operably linked to the anti-TAT antibody- or TAT polypeptide-encoding nucleic acid sequence to direct mRNA synthesis. Promoters recognized by a variety of potential host cells are well known. Promoters suitable for use with prokaryotic hosts include the β-lactamase and lactose promoter systems [Chang et al., *Nature,* 275:615 (1978); Goeddel et al., *Nature,* 281:544 (1979)], alkaline phosphatase, a tryptophan (trp) promoter system [Goeddel, *Nucleic Acids Res.,* 8:4057 (1980); EP 36,776], and hybrid promoters such as the tac promoter [deBoer et al., *Proc. Natl. Acad. Sci. USA,* 80:21-25 (1983)]. Promoters for use in bacterial systems also will contain a Shine-Dalgarno (S.D.) sequence operably linked to the DNA encoding anti-TAT antibody or TAT polypeptide.

Examples of suitable promoting sequences for use with yeast hosts include the promoters for 3 phosphoglycerate kinase [Hitzeman et al., *J. Biol. Chem.,* 255:2073 (1980)] or other glycolytic enzymes [Hess et al., *J. Adv. Enzyme Reg.,* 7:149 (1968); Holland, *Biochemistry,* 17:4900 (1978)], such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

Anti-TAT antibody or TAT polypeptide transcription from vectors in mammalian host cells is controlled, for example, by promoters obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the anti-TAT antibody or TAT polypeptide by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. The enhancer may be spliced into the vector at a position 5' or 3' to the anti-TAT antibody or TAT polypeptide coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding anti-TAT antibody or TAT polypeptide.

Still other methods, vectors, and host cells suitable for adaptation to the synthesis of anti-TAT antibody or TAT polypeptide in recombinant vertebrate cell culture are described in Gething et al., *Nature,* 293:620-625 (1981); Mantei et al., *Nature,* 281:40-46 (1979); EP 117,060; and EP 117,058.

4. Culturing the Host Cells

The host cells used to produce the anti-TAT antibody or TAT polypeptide of this invention may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., *Meth. Enz.* 58:44 (1979), Barnes et al., *Anal. Biochem.* 102: 255 (1980), U.S. Pat. No. 4,767,704; 4,657,866; 4,927,762; 4,560,655; or 5,122,469; WO 90/03430; WO 87/00195; or U.S. Pat. Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

5. Detecting Gene Amplification/Expression

Gene amplification and/or expression may be measured in a sample directly, for example, by conventional Southern blotting, Northern blotting to quantitate the transcription of mRNA [Thomas, *Proc. Natl. Acad. Sci. USA,* 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence TAT polypeptide or against a synthetic peptide based on the DNA sequences provided herein or against exogenous sequence fused to TAT DNA and encoding a specific antibody epitope.

6. Purification of Anti-TAT Antibody and TAT Polypeptide

Forms of anti-TAT antibody and TAT polypeptide may be recovered from culture medium or from host cell lysates. If membrane-bound, it can be released from the membrane using a suitable detergent solution (e.g. Triton-X 100) or by enzymatic cleavage. Cells employed in expression of anti-TAT antibody and TAT polypeptide can be disrupted by various physical or chemical means, such as freeze-thaw cycling, sonication, mechanical disruption, or cell lysing agents.

It may be desired to purify anti-TAT antibody and TAT polypeptide from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms of the anti-TAT antibody and TAT polypeptide. Various methods of protein purification may be employed and such methods are known in the art and described for example in Deutscher, *Methods in Enzymology,* 182 (1990); Scopes, *Protein Purification: Principles and Practice*, Springer-Verlag, New York (1982). The purification step(s) selected will depend, for example, on the nature of the production process used and the particular anti-TAT antibody or TAT polypeptide produced.

When using recombinant techniques, the antibody can be produced intracellularly, in the periplasmic space, or directly secreted into the medium. If the antibody is produced intracellularly, as a first step, the particulate debris, either host cells or lysed fragments, are removed, for example, by centrifugation or ultrafiltration. Carter et al., *Bio/Technology* 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody composition prepared from the cells can be purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human $\gamma 1$, $\gamma 2$ or $\gamma 4$ heavy chains (Lindmark et al., *J. Immunol. Meth.* 62:1-13 (1983)). Protein G is recommended for all mouse isotypes and for human $\gamma 3$ (Guss et al., *EMBO J.* 5:15671575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a $C_H3$ domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the antibody of interest and contaminants may be subjected to low pH hydrophobic interaction chromatography using an elution buffer at a pH between about 2.5-4.5, preferably performed at low salt concentrations (e.g., from about 0-0.25M salt).

J. Pharmaceutical Formulations

Therapeutic formulations of the anti-TAT antibodies, TAT binding oligopeptides, TAT binding organic molecules and/or TAT polypeptides used in accordance with the present invention are prepared for storage by mixing the antibody, polypeptide, oligopeptide or organic molecule having the desired degree of purity with optional pharmaceutically acceptable carriers, excipients or stabilizers *Remington's Pharmaceutical Sciences* 16th edition, Osol, A. Ed. (1980)), in the form of lyophilized formulations or aqueous solutions. Acceptable carriers, excipients, or stabilizers are nontoxic to recipients at the dosages and concentrations employed, and include buffers such as acetate, Tris, phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; tonicifiers such as trehalose and sodium chloride; sugars such as sucrose, mannitol, trehalose or sorbitol; surfactant such as polysorbate; salt-forming counter-ions such as sodium; metal complexes (e.g., Zn-protein complexes); and/or non-ionic surfactants such as TWEEN®, PLURONICS® or polyethylene glycol (PEG). The antibody preferably comprises the antibody at a concentration of between 5-200 mg/ml, preferably between 10-100 mg/ml.

The formulations herein may also contain more than one active compound as necessary for the particular indication being treated, preferably those with complementary activities that do not adversely affect each other. For example, in addition to an anti-TAT antibody, TAT binding oligopeptide, or TAT binding organic molecule, it may be desirable to include in the one formulation, an additional antibody, e.g., a second anti-TAT antibody which binds a different epitope on the TAT polypeptide, or an antibody to some other target such as a growth factor that affects the growth of the particular cancer. Alternatively, or additionally, the composition may further comprise a chemotherapeutic agent, cytotoxic agent, cytokine, growth inhibitory agent, anti-hormonal agent, and/or cardioprotectant. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in *Remington's Pharmaceutical Sciences,* 16th edition, Osol, A. Ed. (1980).

Sustained-release preparations may be prepared. Suitable examples of sustained-release preparations include semi-permeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and $\gamma$ ethyl-L-glutamate, non-degradable ethylene-vinyl acetate, degradable lactic acid-glycolic acid copolymers such as the LUPRON DEPOT® (injectable microspheres composed of lactic acid-glycolic acid copolymer and leuprolide acetate), and poly-D-(−)-3-hydroxybutyric acid.

The formulations to be used for in vivo administration must be sterile. This is readily accomplished by filtration through sterile filtration membranes.

K. Diagnosis and Treatment with Anti-TAT Antibodies, TAT Binding Oligopeptides and TAT Binding Organic Molecules To determine TAT expression in the cancer, various diagnostic assays are available. In one embodiment, TAT polypeptide overexpression may be analyzed by immunohistochemistry (IHC). Parrafin embedded tissue sections from a tumor biopsy may be subjected to the IHC assay and accorded a TAT protein staining intensity criteria as follows:

Score 0—no staining is observed or membrane staining is observed in less than 10% of tumor cells.

Score 1+—a faint/barely perceptible membrane staining is detected in more than 10% of the tumor cells. The cells are only stained in part of their membrane.

Score 2+—a weak to moderate complete membrane staining is observed in more than 10% of the tumor cells.

Score 3+—a moderate to strong complete membrane staining is observed in more than 10% of the tumor cells.

Those tumors with 0 or 1+ scores for TAT polypeptide expression may be characterized as not overexpressing TAT, whereas those tumors with 2+ or 3+ scores may be characterized as overexpressing TAT.

Alternatively, or additionally, FISH assays such as the INFORM® (sold by Ventana, Arizona) or PATHVISION® (Vysis, Illinois) may be carried out on formalin-fixed, paraffin-embedded tumor tissue to determine the extent (if any) of TAT overexpression in the tumor.

TAT overexpression or amplification may be evaluated using an in vivo diagnostic assay, e.g., by administering a molecule (such as an antibody, oligopeptide or organic molecule) which binds the molecule to be detected and is tagged with a detectable label (e.g., a radioactive isotope or a fluorescent label) and externally scanning the patient for localization of the label.

As described above, the anti-TAT antibodies, oligopeptides and organic molecules of the invention have various non-therapeutic applications. The anti-TAT antibodies, oligopeptides and organic molecules of the present invention can be useful for diagnosis and staging of TAT polypeptide-expressing cancers (e.g., in radioimaging). The antibodies, oligopeptides and organic molecules are also useful for purification or immunoprecipitation of TAT polypeptide from cells, for detection and quantitation of TAT polypeptide in vitro, e.g., in an ELISA or a Western blot, to kill and eliminate TAT-expressing cells from a population of mixed cells as a step in the purification of other cells.

Currently, depending on the stage of the cancer, cancer treatment involves one or a combination of the following therapies: surgery to remove the cancerous tissue, radiation therapy, and chemotherapy. Anti-TAT antibody, oligopeptide or organic molecule therapy may be especially desirable in elderly patients who do not tolerate the toxicity and side effects of chemotherapy well and in metastatic disease where radiation therapy has limited usefulness. The tumor targeting anti-TAT antibodies, oligopeptides and organic molecules of the invention are useful to alleviate TAT-expressing cancers upon initial diagnosis of the disease or during relapse. For therapeutic applications, the anti-TAT antibody, oligopeptide or organic molecule can be used alone, or in combination therapy with, e.g., hormones, antiangiogens, or radiolabelled compounds, or with surgery, cryotherapy, and/or radiotherapy. Anti-TAT antibody, oligopeptide or organic molecule treatment can be administered in conjunction with other forms of conventional therapy, either consecutively with, pre- or post-conventional therapy. Chemotherapeutic drugs such as TAXOTERE® (docetaxel), TAXOL® (palictaxel), estramustine and mitoxantrone are used in treating cancer, in particular, in good risk patients. In the present method of the invention for treating or alleviating cancer, the cancer patient can be administered anti-TAT antibody, oligopeptide or organic molecule in conjunction with treatment with the one or more of the preceding chemotherapeutic agents. In particular, combination therapy with palictaxel and modified derivatives (see, e.g., EP0600517) is contemplated. The anti-TAT antibody, oligopeptide or organic molecule will be administered with a therapeutically effective dose of the chemotherapeutic agent. In another embodiment, the anti-TAT antibody, oligopeptide or organic molecule is administered in conjunction with chemotherapy to enhance the activity and efficacy of the chemotherapeutic agent, e.g., paclitaxel. The Physicians' Desk Reference (PDR) discloses dosages of these agents that have been used in treatment of various cancers. The dosing regimen and dosages of these aforementioned chemotherapeutic drugs that are therapeutically effective will depend on the particular cancer being treated, the extent of the disease and other factors familiar to the physician of skill in the art and can be determined by the physician.

In one particular embodiment, a conjugate comprising an anti-TAT antibody, oligopeptide or organic molecule conjugated with a cytotoxic agent is administered to the patient. Preferably, the immunoconjugate bound to the TAT protein is internalized by the cell, resulting in increased therapeutic efficacy of the immunoconjugate in killing the cancer cell to which it binds. In a preferred embodiment, the cytotoxic agent targets or interferes with the nucleic acid in the cancer cell. Examples of such cytotoxic agents are described above and include maytansinoids, calicheamicins, ribonucleases and DNA endonucleases.

The anti-TAT antibodies, oligopeptides, organic molecules or toxin conjugates thereof are administered to a human patient, in accord with known methods, such as intravenous administration, e.g., as a bolus or by continuous infusion over a period of time, by intramuscular, intraperitoneal, intracerobrospinal, subcutaneous, intra-articular, intrasynovial, intrathecal, oral, topical, or inhalation routes. Intravenous or subcutaneous administration of the antibody, oligopeptide or organic molecule is preferred.

Other therapeutic regimens may be combined with the administration of the anti-TAT antibody, oligopeptide or organic molecule. The combined administration includes co-administration, using separate formulations or a single pharmaceutical formulation, and consecutive administration in either order, wherein preferably there is a time period while both (or all) active agents simultaneously exert their biological activities. Preferably such combined therapy results in a synergistic therapeutic effect.

It may also be desirable to combine administration of the anti-TAT antibody or antibodies, oligopeptides or organic molecules, with administration of an antibody directed against another tumor antigen associated with the particular cancer.

In another embodiment, the therapeutic treatment methods of the present invention involves the combined administration of an anti-TAT antibody (or antibodies), oligopeptides or organic molecules and one or more chemotherapeutic agents or growth inhibitory agents, including co-administration of cocktails of different chemotherapeutic agents. Chemotherapeutic agents include estramustine phosphate, prednimustine, cisplatin, 5-fluorouracil, melphalan, cyclophosphamide, hydroxyurea and hydroxyureataxanes (such as paclitaxel and doxetaxel) and/or anthracycline antibiotics. Preparation and dosing schedules for such chemotherapeutic agents may be used according to manufacturers' instructions or as determined empirically by the skilled practitioner. Preparation and dosing schedules for such chemotherapy are also described in Chemotherapy Service Ed., M. C. Perry, Williams & Wilkins, Baltimore, Md. (1992).

The antibody, oligopeptide or organic molecule may be combined with an anti-hormonal compound; e.g., an anti-estrogen compound such as tamoxifen; an anti-progesterone such as onapristone (see, EP 616 812); or an anti-androgen such as flutamide, in dosages known for such molecules. Where the cancer to be treated is androgen independent cancer, the patient may previously have been subjected to anti-androgen therapy and, after the cancer becomes androgen independent, the anti-TAT antibody, oligopeptide or organic molecule (and optionally other agents as described herein) may be administered to the patient.

Sometimes, it may be beneficial to also co-administer a cardioprotectant (to prevent or reduce myocardial dysfunction associated with the therapy) or one or more cytokines to the patient. In addition to the above therapeutic regimes, the patient may be subjected to surgical removal of cancer cells and/or radiation therapy, before, simultaneously with, or post antibody, oligopeptide or organic molecule therapy. Suitable dosages for any of the above co-administered agents are those presently used and may be lowered due to the combined action (synergy) of the agent and anti-TAT antibody, oligopeptide or organic molecule.

For the prevention or treatment of disease, the dosage and mode of administration will be chosen by the physician according to known criteria. The appropriate dosage of antibody, oligopeptide or organic molecule will depend on the type of disease to be treated, as defined above, the severity and course of the disease, whether the antibody, oligopeptide or organic molecule is administered for preventive or therapeutic purposes, previous therapy, the patient's clinical history and response to the antibody, oligopeptide or organic molecule, and the discretion of the attending physician. The antibody, oligopeptide or organic molecule is suitably administered to the patient at one time or over a series of treatments. Preferably, the antibody, oligopeptide or organic molecule is administered by intravenous infusion or by subcutaneous injections. Depending on the type and severity of the disease, about 1 μg/kg to about 50 mg/kg body weight (e.g., about 0.1-15 mg/kg/dose) of antibody can be an initial candidate dosage for administration to the patient, whether, for example, by one or more separate administrations, or by continuous infusion. A dosing regimen can comprise administering an initial loading dose of about 4 mg/kg, followed by a weekly maintenance dose of about 2 mg/kg of the anti-TAT antibody. However, other dosage regimens may be useful. A typical daily dosage might range from about 1 μg/kg to 100 mg/kg or more, depending on the factors mentioned above. For repeated administrations over several days or longer, depending on the condition, the treatment is sustained until a desired suppression of disease symptoms occurs. The progress of this therapy can be readily monitored by conventional methods and assays and based on criteria known to the physician or other persons of skill in the art.

Aside from administration of the antibody protein to the patient, the present application contemplates administration of the antibody by gene therapy. Such administration of nucleic acid encoding the antibody is encompassed by the expression "administering a therapeutically effective amount of an antibody". See, for example, WO96/07321 published Mar. 14, 1996 concerning the use of gene therapy to generate intracellular antibodies.

There are two major approaches to getting the nucleic acid (optionally contained in a vector) into the patient's cells; in vivo and ex vivo. For in vivo delivery the nucleic acid is injected directly into the patient, usually at the site where the antibody is required. For ex vivo treatment, the patient's cells are removed, the nucleic acid is introduced into these isolated cells and the modified cells are administered to the patient either directly or, for example, encapsulated within porous membranes which are implanted into the patient (see, e.g., U.S. Pat. Nos. 4,892,538 and 5,283,187). There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. A commonly used vector for ex vivo delivery of the gene is a retroviral vector.

The currently preferred in vivo nucleic acid transfer techniques include transfection with viral vectors (such as adenovirus, Herpes simplex I virus, or adeno-associated virus) and lipid-based systems (useful lipids for lipid-mediated transfer of the gene are DOTMA, DOPE and DC-Chol, for example). For review of the currently known gene marking and gene therapy protocols see Anderson et al., *Science* 256:808-813 (1992). See also WO 93/25673 and the references cited therein.

The anti-TAT antibodies of the invention can be in the different forms encompassed by the definition of "antibody" herein. Thus, the antibodies include full length or intact antibody, antibody fragments, native sequence antibody or amino acid variants, humanized, chimeric or fusion antibodies, immunoconjugates, and functional fragments thereof. In fusion antibodies an antibody sequence is fused to a heterologous polypeptide sequence. The antibodies can be modified in the Fc region to provide desired effector functions. As discussed in more detail in the sections herein, with the appropriate Fc regions, the naked antibody bound on the cell surface can induce cytotoxicity, e.g., via antibody-dependent cellular cytotoxicity (ADCC) or by recruiting complement in complement dependent cytotoxicity, or some other mechanism. Alternatively, where it is desirable to eliminate or reduce effector function, so as to minimize side effects or therapeutic complications, certain other Fc regions may be used.

In one embodiment, the antibody competes for binding or bind substantially to, the same epitope as the antibodies of the invention. Antibodies having the biological characteristics of the present anti-TAT antibodies of the invention are also contemplated, specifically including the in vivo tumor targeting and any cell proliferation inhibition or cytotoxic characteristics.

Methods of producing the above antibodies are described in detail herein.

The present anti-TAT antibodies, oligopeptides and organic molecules are useful for treating a TAT-expressing cancer or alleviating one or more symptoms of the cancer in a mammal. Such a cancer includes prostate cancer, cancer of the urinary tract, lung cancer, breast cancer, colon cancer and ovarian cancer, more specifically, prostate adenocarcinoma, renal cell carcinomas, colorectal adenocarcinomas, lung adenocarcinomas, lung squamous cell carcinomas, and pleural mesothelioma and all cancers or tumors of glial origin. The cancers encompass metastatic cancers of any of the preceding. The antibody, oligopeptide or organic molecule is able to bind to at least a portion of the cancer cells that express TAT polypeptide in the mammal. In a preferred embodiment, the antibody, oligopeptide or organic molecule is effective to destroy or kill TAT-expressing tumor cells or inhibit the growth of such tumor cells, in vitro or in vivo, upon binding to TAT polypeptide on the cell or in secreted form. Such an antibody includes a naked anti-TAT antibody (not conjugated to any agent). Naked antibodies that have cytotoxic or cell growth inhibition properties can be further harnessed with a cytotoxic agent to render them even more potent in tumor cell destruction. Cytotoxic properties can be conferred to an anti-TAT antibody by, e.g., conjugating the antibody with a cytotoxic agent, to form an immunoconjugate as described herein. The cytotoxic agent or a growth inhibitory agent is preferably a small molecule. Toxins such as calicheamicin or a maytansinoid and analogs or derivatives thereof, are preferable.

The invention provides a composition comprising an anti-TAT antibody, oligopeptide or organic molecule of the invention, and a carrier. For the purposes of treating cancer, compositions can be administered to the patient in need of such treatment, wherein the composition can comprise one or more anti-TAT antibodies present as an immunoconjugate or as the naked antibody. In a further embodiment, the compositions can comprise these antibodies, oligopeptides or organic molecules in combination with other therapeutic agents such as cytotoxic or growth inhibitory agents, including chemotherapeutic agents. The invention also provides formulations comprising an anti-TAT antibody, oligopeptide or organic molecule of the invention, and a carrier. In one embodiment, the formulation is a therapeutic formulation comprising a pharmaceutically acceptable carrier.

Another aspect of the invention is isolated nucleic acids encoding the anti-TAT antibodies. Nucleic acids encoding both the H and L chains and especially the hypervariable region residues, chains which encode the native sequence antibody as well as variants, modifications and humanized versions of the antibody, are encompassed.

The invention also provides methods useful for treating a TAT polypeptide-expressing cancer or alleviating one or more symptoms of the cancer in a mammal, comprising administering a therapeutically effective amount of an anti-TAT antibody, oligopeptide or organic molecule to the mammal. The antibody, oligopeptide or organic molecule therapeutic compositions can be administered short term (acute) or chronic, or intermittent as directed by physician. Also provided are methods of inhibiting the growth of, and killing a TAT polypeptide-expressing cell.

The invention also provides kits and articles of manufacture comprising at least one anti-TAT antibody, oligopeptide or organic molecule. Kits containing anti-TAT antibodies, oligopeptides or organic molecules find use, e.g., for TAT cell killing assays, for purification or immunoprecipitation of TAT polypeptide from cells. For example, for isolation and purification of TAT, the kit can contain an anti-TAT antibody, oligopeptide or organic molecule coupled to beads (e.g., sepharose beads). Kits can be provided which contain the antibodies, oligopeptides or organic molecules for detection and quantitation of TAT in vitro, e.g., in an ELISA or a Western blot. Such antibody, oligopeptide or organic molecule useful for detection may be provided with a label such as a fluorescent or radiolabel.

L. Articles of Manufacture and Kits

Another embodiment of the invention is an article of manufacture containing materials useful for the treatment of anti-TAT expressing cancer. The article of manufacture comprises a container and a label or package insert on or associated with the container. Suitable containers include, for example, bottles, vials, syringes, etc. The containers may be formed from a variety of materials such as glass or plastic. The container holds a composition which is effective for treating the cancer condition and may have a sterile access port (for example the container may be an intravenous solution bag or a vial having a stopper pierceable by a hypodermic injection needle). At least one active agent in the composition is an anti-TAT antibody, oligopeptide or organic molecule of the invention. The label or package insert indicates that the composition is used for treating cancer. The label or package insert will further comprise instructions for administering the antibody, oligopeptide or organic molecule composition to the cancer patient. Additionally, the article of manufacture may further comprise a second container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

Kits are also provided that are useful for various purposes, e.g., for TAT-expressing cell killing assays, for purification or immunoprecipitation of TAT polypeptide from cells. For isolation and purification of TAT polypeptide, the kit can contain an anti-TAT antibody, oligopeptide or organic molecule coupled to beads (e.g., sepharose beads). Kits can be provided which contain the antibodies, oligopeptides or organic molecules for detection and quantitation of TAT polypeptide in vitro, e.g., in an ELISA or a Western blot. As with the article of manufacture, the kit comprises a container and a label or package insert on or associated with the container. The container holds a composition comprising at least one anti-TAT antibody, oligopeptide or organic molecule of the invention. Additional containers may be included that contain, e.g., diluents and buffers, control antibodies. The label or package insert may provide a description of the composition as well as instructions for the intended in vitro or diagnostic use.

M. Uses for TAT Polypeptides and TAT-Polypeptides Encoding Nucleic Acids

Nucleotide sequences (or their complement) encoding TAT polypeptides have various applications in the art of molecular biology, including uses as hybridization probes, in chromosome and gene mapping and in the generation of anti-sense RNA and DNA probes. TAT-encoding nucleic acid will also be useful for the preparation of TAT polypeptides by the recombinant techniques described herein, wherein those TAT polypeptides may find use, for example, in the preparation of anti-TAT antibodies as described herein.

The full-length native sequence TAT gene, or portions thereof, may be used as hybridization probes for a cDNA library to isolate the full-length TAT cDNA or to isolate still other cDNAs (for instance, those encoding naturally-occurring variants of TAT or TAT from other species) which have a desired sequence identity to the native TAT sequence disclosed herein. Optionally, the length of the probes will be about 20 to about 50 bases. The hybridization probes may be derived from at least partially novel regions of the full length native nucleotide sequence wherein those regions may be determined without undue experimentation or from genomic sequences including promoters, enhancer elements and introns of native sequence TAT. By way of example, a screening method will comprise isolating the coding region of the TAT gene using the known DNA sequence to synthesize a selected probe of about 40 bases. Hybridization probes may be labeled by a variety of labels, including radionucleotides such as $^{32}P$ or $^{35}S$, or enzymatic labels such as alkaline phosphatase coupled to the probe via avidin/biotin coupling systems. Labeled probes having a sequence complementary to that of the TAT gene of the present invention can be used to screen libraries of human cDNA, genomic DNA or mRNA to determine which members of such libraries the probe hybridizes to. Hybridization techniques are described in further detail in the Examples below. Any EST sequences disclosed in the present application may similarly be employed as probes, using the methods disclosed herein.

Other useful fragments of the TAT-encoding nucleic acids include antisense or sense oligonucleotides comprising a singe-stranded nucleic acid sequence (either RNA or DNA) capable of binding to target TAT mRNA (sense) or TAT DNA (antisense) sequences. Antisense or sense oligonucleotides, according to the present invention, comprise a fragment of the coding region of TAT DNA. Such a fragment generally comprises at least about 14 nucleotides, preferably from about 14 to 30 nucleotides. The ability to derive an antisense or a sense oligonucleotide, based upon a cDNA sequence encoding a given protein is described in, for example, Stein and Cohen (*Cancer Res.* 48:2659, 1988) and van der Krol et al. (*BioTechniques* 6:958, 1988).

Binding of antisense or sense oligonucleotides to target nucleic acid sequences results in the formation of duplexes that block transcription or translation of the target sequence by one of several means, including enhanced degradation of the duplexes, premature termination of transcription or translation, or by other means. Such methods are encompassed by the present invention. The antisense oligonucleotides thus may be used to block expression of TAT proteins, wherein those TAT proteins may play a role in the induction of cancer in mammals. Antisense or sense oligonucleotides further comprise oligonucleotides having modified sugar-phosphodiester backbones (or other sugar linkages, such as those described in WO 91/06629) and wherein such sugar linkages are resistant to endogenous nucleases. Such oligonucleotides with resistant sugar linkages are stable in vivo (i.e., capable of resisting enzymatic degradation) but retain sequence specificity to be able to bind to target nucleotide sequences.

Preferred intragenic sites for antisense binding include the region incorporating the translation initiation/start codon (5'-AUG/5'-ATG) or termination/stop codon (5'-UAA, 5'-UAG and 5-UGA/5'-TAA, 5'-TAG and 5'-TGA) of the open reading frame (ORF) of the gene. These regions refer to a portion of the mRNA or gene that encompasses from about 25 to about 50 contiguous nucleotides in either direction (i.e., 5' or 3') from a translation initiation or termination codon. Other preferred regions for antisense binding include: introns; exons; intron-exon junctions; the open reading frame (ORF) or "coding region," which is the region between the translation initiation codon and the translation termination codon; the 5' cap of an mRNA which comprises an N7-methylated guanosine residue joined to the 5'-most residue of the mRNA via a 5'-5' triphosphate linkage and includes 5' cap structure itself as well as the first 50 nucleotides adjacent to the cap; the 5' untranslated region (5'UTR), the portion of an mRNA in the 5' direction from the translation initiation codon, and thus including nucleotides between the 5' cap site and the translation initiation codon of an mRNA or corresponding nucleotides on the gene; and the 3' untranslated region (3'UTR), the portion of an mRNA in the 3' direction from the translation termination codon, and thus including nucleotides between the translation termination codon and 3' end of an mRNA or corresponding nucleotides on the gene.

Specific examples of preferred antisense compounds useful for inhibiting expression of TAT proteins include oligonucleotides containing modified backbones or non-natural internucleoside linkages. Oligonucleotides having modified backbones include those that retain a phosphorus atom in the backbone and those that do not have a phosphorus atom in the backbone. For the purposes of this specification, and as sometimes referenced in the art, modified oligonucleotides that do not have a phosphorus atom in their internucleoside backbone can also be considered to be oligonucleosides. Preferred modified oligonucleotide backbones include, for example, phosphorothioates, chiral phosphorothioates, phosphorodithioates, phosphotriesters, aminoalkylphosphotri-esters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, selenophosphates and borano-phosphates having normal 3'-5' linkages, 2'-5' linked analogs of these, and those having inverted polarity wherein one or more internucleotide linkages is a 3' to 3', 5' to 5' or 2' to 2' linkage. Preferred oligonucleotides having inverted polarity comprise a single 3' to 3' linkage at the 3'-most internucleotide linkage i.e. a single inverted nucleoside residue which may be a basic (the nucleobase is missing or has a hydroxyl group in place thereof). Various salts, mixed salts and free acid forms are also included. Representative United States patents that teach the preparation of phosphorus-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; 5,194,599; 5,565,555; 5,527,899; 5,721,218; 5,672,697 and 5,625,050, each of which is herein incorporated by reference.

Preferred modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; riboacetyl backbones; alkene containing backbones; sulfamate backbones; methyleneimino and methylenehydrazino backbones; sulfonate and sulfonamide backbones; amide backbones; and others having mixed N, O, S and CH.sub.2 component parts. Representative United States patents that teach the preparation of such oligonucleosides include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; 5,792,608; 5,646,269 and 5,677,439, each of which is herein incorporated by reference.

In other preferred antisense oligonucleotides, both the sugar and the internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, in particular an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., *Science,* 1991, 254, 1497-1500.

Preferred antisense oligonucleotides incorporate phosphorothioate backbones and/or heteroatom backbones, and in particular —$CH_2$—NH—O—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —O—N($CH_3$)—$CH_2$—$CH_2$— [wherein the native phosphodiester backbone is represented as —O—P—O—$CH_2$—] described in the above referenced U.S. Pat. No. 5,489,677, and the amide backbones of the above referenced U.S. Pat. No. 5,602,240. Also preferred are antisense oligonucleotides having morpholino backbone structures of the above-referenced U.S. Pat. No. 5,034,506.

Modified oligonucleotides may also contain one or more substituted sugar moieties. Preferred oligonucleotides comprise one of the following at the 2' position: OH; F; O-alkyl, S-alkyl, or N-alkyl; O-alkenyl, S-alkynyl, or N-alkenyl; O-alkynyl, S-alkynyl or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Particularly preferred are $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. Other preferred antisense oligonucleotides comprise one of the following at the 2' position: $C_1$ to $C_{10}$ lower alkyl, substituted lower alkyl, alkenyl, alkynyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. A preferred modification includes 2'-methoxyethoxy (2'-O—$CH_2CH_2OCH_3$, also known as 2'-O-(2-methoxyethyl) or 2'-MOE) (Martin et al., Helv. Chim. Acta, 1995, 78, 486-504) i.e., an alkoxyalkoxy group. A further preferred modification includes 2'-dimethylaminooxyethoxy, i.e., a $O(CH_2)_2ON(CH_3)_2$ group, also known as 2'-DMAOE, as described in examples hereinbelow, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$).

A further preferred modification includes Locked Nucleic Acids (LNAs) in which the 2'-hydroxyl group is linked to the 3' or 4' carbon atom of the sugar ring thereby forming a bicyclic sugar moiety. The linkage is preferably a methelyne (—$CH_2$—), group bridging the 2' oxygen atom and the 4' carbon atom wherein n is 1 or 2. LNAs and preparation thereof are described in WO 98/39352 and WO 99/14226.

Other preferred modifications include 2'-methoxy (2'-O—$CH_3$), 2'-aminopropoxy (2'-$OCH_2CH_2CH_2NH_2$), 2'-allyl (2'-$CH_2$—CH═$CH_2$), 2'-O-allyl (2'-O—$CH_2$—CH═$CH_2$) and 2'-fluoro (2'-F). The 2'-modification may be in the arabino (up) position or ribo (down) position. A preferred 2'-arabino modification is 2'-F. Similar modifications may also be made at other positions on the oligonucleotide, particularly the 3' position of the sugar on the 3' terminal nucleotide or in 2'-5' linked oligonucleotides and the 5' position of 5' terminal nucleotide. Oligonucleotides may also have sugar mimetics such as cyclobutyl moieties in place of the pentofuranosyl sugar. Representative United States patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; 5,792,747; and 5,700,920, each of which is herein incorporated by reference in its entirety.

Oligonucleotides may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl ($-C\equiv C-CH_3$ or $-CH_2-C\equiv CH$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. Further modified nucleobases include tricyclic pyrimidines such as phenoxazine cytidine(1H-pyrimido[5,4-b][1,4]benzoxazin-2(3H)-one), phenothiazine cytidine (1H-pyrimido[5,4-b][1,4]benzothiazin-2(3H)-one), G-clamps such as a substituted phenoxazine cytidine (e.g. 9-(2-aminoethoxy)-H-pyrimido[5,4-b][1,4]benzoxazin-2(3H)-one), carbazole cytidine (2H-pyrimido[4,5-b]indol-2-one), pyridoindole cytidine (H-pyrido[3',2':4,5]pyrrolo[2,3-d]pyrimidin-2-one). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in U.S. Pat. No. 3,687,808, those disclosed in The Concise Encyclopedia Of Polymer Science And Engineering, pages 858-859, Kroschwitz, J. I., ed. John Wiley & Sons, 1990, and those disclosed by Englisch et al., Angewandte Chemie, International Edition, 1991, 30, 613. Certain of these nucleobases are particularly useful for increasing the binding affinity of the oligomeric compounds of the invention. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2.degree. C. (Sanghvi et al, Antisense Research and Applications, CRC Press, Boca Raton, 1993, pp. 276-278) and are preferred base substitutions, even more particularly when combined with 2'-O-methoxyethyl sugar modifications. Representative United States patents that teach the preparation of modified nucleobases include, but are not limited to: U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,645,985; 5,830,653; 5,763,588; 6,005,096; 5,681,941 and 5,750,692, each of which is herein incorporated by reference.

Another modification of antisense oligonucleotides chemically linking to the oligonucleotide one or more moieties or conjugates which enhance the activity, cellular distribution or cellular uptake of the oligonucleotide. The compounds of the invention can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugates groups include cholesterols, lipids, cation lipids, phospholipids, cationic phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve oligomer uptake, enhance oligomer resistance to degradation, and/or strengthen sequence-specific hybridization with RNA. Groups that enhance the pharmacokinetic properties, in the context of this invention, include groups that improve oligomer uptake, distribution, metabolism or excretion. Conjugate moieties include but are not limited to lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-5-tritylthiol (Manoharan et al., Ann. N.Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-oxycholesterol moiety. Oligonucleotides of the invention may also be conjugated to active drug substances, for example, aspirin, warfarin, phenylbutazone, ibuprofen, suprofen, fenbufen, ketoprofen, (S)-(+)-pranoprofen, carprofen, dansylsarcosine, 2,3,5-triiodobenzoic acid, flufenamic acid, folinic acid, a benzothiadiazide, chlorothiazide, a diazepine, indomethicin, a barbiturate, a cephalosporin, a sulfa drug, an antidiabetic, an antibacterial or an antibiotic. Oligonucleotide-drug conjugates and their preparation are described in U.S. patent application Ser. No. 09/334,130 (filed Jun. 15, 1999) and U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

It is not necessary for all positions in a given compound to be uniformly modified, and in fact more than one of the aforementioned modifications may be incorporated in a single compound or even at a single nucleoside within an oligonucleotide. The present invention also includes antisense compounds which are chimeric compounds. "Chimeric" antisense compounds or "chimeras," in the context of this invention, are antisense compounds, particularly oligonucleotides, which contain two or more chemically distinct regions, each made up of at least one monomer unit, i.e., a nucleotide in the case of an oligonucleotide compound. These oligonucleotides typically contain at least one region wherein the oligonucleotide is modified so as to confer upon the oligonucleotide increased resistance to nuclease degradation, increased cellular uptake, and/or increased binding affinity for the target nucleic acid. An additional region of the oligonucleotide may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of oligonucleotide inhibition of gene expression. Consequently, comparable results can often be obtained with shorter oligonucleotides when chimeric oligonucleotides are used, compared to phosphorothioate deoxyoligonucleotides hybridizing to the same target region. Chimeric antisense compounds of the invention may be formed as composite structures of two or more oligonucleotides, modified oligonucleotides, oligonucleosides and/or oligonucleotide mimetics as described above. Preferred chimeric antisense oligonucleotides incorporate at least one 2' modified sugar (preferably 2'-O—$CH_3$) at the 3' terminal to confer nuclease resistance and a region with at least 4 contiguous 2'-H sugars to confer RNase H activity. Such compounds have also been referred to in the art as hybrids or gapmers. Preferred gapmers have a region of 2' modified sugars (preferably 2'-O—$(CH_2)_2$—O—$CH_3$) at the 3'-terminal and at the 5' terminal separated by at least one region having at least 4 contiguous 2'-H sugars and preferably incorporate phosphorothioate backbone linkages. Representative United States patents that teach the preparation of such hybrid structures include, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference in its entirety.

The antisense compounds used in accordance with this invention may be conveniently and routinely made through the well-known technique of solid phase synthesis. Equipment for such synthesis is sold by several vendors including, for example, Applied Biosystems (Foster City, Calif.). Any other means for such synthesis known in the art may additionally or alternatively be employed. It is well known to use similar techniques to prepare oligonucleotides such as the phosphorothioates and alkylated derivatives. The compounds of the invention may also be admixed, encapsulated, conjugated or otherwise associated with other molecules, molecule structures or mixtures of compounds, as for example, liposomes, receptor targeted molecules, oral, rectal, topical or other formulations, for assisting in uptake, distribution and/or absorption. Representative United States patents that teach the preparation of such uptake, distribution and/or absorption assisting formulations include, but are not limited to, U.S. Pat. Nos. 5,108,921; 5,354,844; 5,416,016; 5,459,127; 5,521,291; 5,543,158; 5,547,932; 5,583,020; 5,591,721; 4,426,330; 4,534,899; 5,013,556; 5,108,921; 5,213,804; 5,227,170; 5,264,221; 5,356,633; 5,395,619; 5,416,016; 5,417,978; 5,462,854; 5,469,854; 5,512,295; 5,527,528; 5,534,259; 5,543,152; 5,556,948; 5,580,575; and 5,595,756, each of which is herein incorporated by reference.

Other examples of sense or antisense oligonucleotides include those oligonucleotides which are covalently linked to organic moieties, such as those described in WO 90/10048, and other moieties that increases affinity of the oligonucleotide for a target nucleic acid sequence, such as poly-(L-lysine). Further still, intercalating agents, such as ellipticine, and alkylating agents or metal complexes may be attached to sense or antisense oligonucleotides to modify binding specificities of the antisense or sense oligonucleotide for the target nucleotide sequence.

Antisense or sense oligonucleotides may be introduced into a cell containing the target nucleic acid sequence by any gene transfer method, including, for example, mediated DNA transfection, electroporation, or by using gene transfer vectors such as Epstein-Barr virus. In a preferred procedure, an antisense or sense oligonucleotide is inserted into a suitable retroviral vector. A cell containing the target nucleic acid sequence is contacted with the recombinant retroviral vector, either in vivo or ex vivo. Suitable retroviral vectors include, but are not limited to, those derived from the murine retrovirus M-MuLV, N2 (a retrovirus derived from M-MuLV), or the double copy vectors designated DCT5A, DCT5B and DCT5C (see WO 90/13641).

Sense or antisense oligonucleotides also may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell.

Alternatively, a sense or an antisense oligonucleotide may be introduced into a cell containing the target nucleic acid sequence by formation of an oligonucleotide-lipid complex, as described in WO 90/10448. The sense or antisense oligonucleotide-lipid complex is preferably dissociated within the cell by an endogenous lipase.

Antisense or sense RNA or DNA molecules are generally at least about 5 nucleotides in length, alternatively at least about 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleotides in length, wherein in this context the term "about" means the referenced nucleotide sequence length plus or minus 10% of that referenced length.

The probes may also be employed in PCR techniques to generate a pool of sequences for identification of closely related TAT coding sequences.

Nucleotide sequences encoding a TAT can also be used to construct hybridization probes for mapping the gene which encodes that TAT and for the genetic analysis of individuals with genetic disorders. The nucleotide sequences provided herein may be mapped to a chromosome and specific regions of a chromosome using known techniques, such as in situ hybridization, linkage analysis against known chromosomal markers, and hybridization screening with libraries.

When the coding sequences for TAT encode a protein which binds to another protein (example, where the TAT is a receptor), the TAT can be used in assays to identify the other proteins or molecules involved in the binding interaction. By such methods, inhibitors of the receptor/ligand binding interaction can be identified. Proteins involved in such binding interactions can also be used to screen for peptide or small molecule inhibitors or agonists of the binding interaction. Also, the receptor TAT can be used to isolate correlative ligand(s). Screening assays can be designed to find lead compounds that mimic the biological activity of a native TAT or a receptor for TAT. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

Nucleic acids which encode TAT or its modified forms can also be used to generate either transgenic animals or "knock out" animals which, in turn, are useful in the development and screening of therapeutically useful reagents. A transgenic animal (e.g., a mouse or rat) is an animal having cells that contain a transgene, which transgene was introduced into the animal or an ancestor of the animal at a prenatal, e.g., an embryonic stage. A transgene is a DNA which is integrated into the genome of a cell from which a transgenic animal develops. In one embodiment, cDNA encoding TAT can be used to clone genomic DNA encoding TAT in accordance with established techniques and the genomic sequences used to generate transgenic animals that contain cells which express DNA encoding TAT. Methods for generating transgenic animals, particularly animals such as mice or rats, have become conventional in the art and are described, for example, in U.S. Pat. Nos. 4,736,866 and 4,870,009. Typically, particular cells would be targeted for TAT transgene incorporation with tissue-specific enhancers. Transgenic animals that include a copy of a transgene encoding TAT introduced into the germ line of the animal at an embryonic stage can be used to examine the effect of increased expression of DNA encoding TAT. Such animals can be used as tester animals for reagents thought to confer protection from, for example, pathological conditions associated with its overexpression. In accordance with this facet of the invention, an animal is treated with the reagent and a reduced incidence of the pathological condition, compared to untreated animals bearing the transgene, would indicate a potential therapeutic intervention for the pathological condition.

Alternatively, non-human homologues of TAT can be used to construct a TAT "knock out" animal which has a defective or altered gene encoding TAT as a result of homologous recombination between the endogenous gene encoding TAT and altered genomic DNA encoding TAT introduced into an embryonic stem cell of the animal. For example, cDNA encoding TAT can be used to clone genomic DNA encoding TAT in accordance with established techniques. A portion of the genomic DNA encoding TAT can be deleted or replaced with another gene, such as a gene encoding a selectable marker which can be used to monitor integration. Typically, several kilobases of unaltered flanking DNA (both at the 5' and 3' ends) are included in the vector [see e.g., Thomas and Capecchi, *Cell,* 51:503 (1987) for a description of homologous recombination vectors]. The vector is introduced into an embryonic stem cell line (e.g., by electroporation) and cells in which the introduced DNA has homologously recombined with the endogenous DNA are selected [see e.g., Li et al., *Cell,* 69:915 (1992)]. The selected cells are then injected into a blastocyst of an animal (e.g., a mouse or rat) to form aggregation chimeras [see e.g., Bradley, in *Teratocarcinomas and Embryonic Stem Cells: A Practical Approach*, E. J. Robertson, ed. (IRL, Oxford, 1987), pp. 113-152]. A chimeric embryo can then be implanted into a suitable pseudopregnant female foster animal and the embryo brought to term to create a "knock out" animal. Progeny harboring the homologously recombined DNA in their germ cells can be identified by standard techniques and used to breed animals in which all cells of the animal contain the homologously recombined DNA. Knockout animals can be characterized for instance, for their ability to defend against certain pathological conditions and for their development of pathological conditions due to absence of the TAT polypeptide.

Nucleic acid encoding the TAT polypeptides may also be used in gene therapy. In gene therapy applications, genes are introduced into cells in order to achieve in vivo synthesis of a therapeutically effective genetic product, for example for replacement of a defective gene. "Gene therapy" includes both conventional gene therapy where a lasting effect is achieved by a single treatment, and the administration of gene therapeutic agents, which involves the one time or repeated administration of a therapeutically effective DNA or mRNA. Antisense RNAs and DNAs can be used as therapeutic agents for blocking the expression of certain genes in vivo. It has already been shown that short antisense oligonucleotides can be imported into cells where they act as inhibitors, despite their low intracellular concentrations caused by their restricted uptake by the cell membrane. (Zamecnik et al., *Proc. Natl. Acad. Sci. USA* 83:4143-4146 [1986]). The oligonucleotides can be modified to enhance their uptake, e.g. by substituting their negatively charged phosphodiester groups by uncharged groups.

There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. The currently preferred in vivo gene transfer techniques include transfection with viral (typically retroviral) vectors and viral coat protein-liposome mediated transfection (Dzau et al., *Trends in Biotechnology* 11, 205-210 [1993]). In some situations it is desirable to provide the nucleic acid source with an agent that targets the target cells, such as an antibody specific for a cell surface membrane protein or the target cell, a ligand for a receptor on the target cell, etc. Where liposomes are employed, proteins which bind to a cell surface membrane protein associated with endocytosis may be used for targeting and/or to facilitate uptake, e.g. capsid proteins or fragments thereof tropic for a particular cell type, antibodies for proteins which undergo internalization in cycling, proteins that target intracellular localization and enhance intracellular half-life. The technique of receptor-mediated endocytosis is described, for example, by Wu et al., *J. Biol. Chem.* 262, 4429-4432 (1987); and Wagner et al., *Proc. Natl. Acad. Sci. USA* 87, 3410-3414 (1990). For review of gene marking and gene therapy protocols see Anderson et al., *Science* 256, 808-813 (1992).

The nucleic acid molecules encoding the TAT polypeptides or fragments thereof described herein are useful for chromosome identification. In this regard, there exists an ongoing need to identify new chromosome markers, since relatively few chromosome marking reagents, based upon actual sequence data are presently available. Each TAT nucleic acid molecule of the present invention can be used as a chromosome marker.

The TAT polypeptides and nucleic acid molecules of the present invention may also be used diagnostically for tissue typing, wherein the TAT polypeptides of the present invention may be differentially expressed in one tissue as compared to another, preferably in a diseased tissue as compared to a normal tissue of the same tissue type. TAT nucleic acid molecules will find use for generating probes for PCR, Northern analysis, Southern analysis and Western analysis.

This invention encompasses methods of screening compounds to identify those that mimic the TAT polypeptide (agonists) or prevent the effect of the TAT polypeptide (antagonists). Screening assays for antagonist drug candidates are designed to identify compounds that bind or complex with the TAT polypeptides encoded by the genes identified herein, or otherwise interfere with the interaction of the encoded polypeptides with other cellular proteins, including e.g., inhibiting the expression of TAT polypeptide from cells. Such screening assays will include assays amenable to high-throughput screening of chemical libraries, making them particularly suitable for identifying small molecule drug candidates.

The assays can be performed in a variety of formats, including protein-protein binding assays, biochemical screening assays, immunoassays, and cell-based assays, which are well characterized in the art.

All assays for antagonists are common in that they call for contacting the drug candidate with a TAT polypeptide encoded by a nucleic acid identified herein under conditions and for a time sufficient to allow these two components to interact.

In binding assays, the interaction is binding and the complex formed can be isolated or detected in the reaction mixture. In a particular embodiment, the TAT polypeptide encoded by the gene identified herein or the drug candidate is immobilized on a solid phase, e.g., on a microtiter plate, by covalent or non-covalent attachments. Non-covalent attachment generally is accomplished by coating the solid surface with a solution of the TAT polypeptide and drying. Alternatively, an immobilized antibody, e.g., a monoclonal antibody, specific for the TAT polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labeled antibody specifically binding the immobilized complex.

If the candidate compound interacts with but does not bind to a particular TAT polypeptide encoded by a gene identified herein, its interaction with that polypeptide can be assayed by methods well known for detecting protein-protein interactions. Such assays include traditional approaches, such as, e.g., cross-linking, co-immunoprecipitation, and co-purification through gradients or chromatographic columns. In addition, protein-protein interactions can be monitored by using a yeast-based genetic system described by Fields and co-workers (Fields and Song, *Nature* (*London*), 340:245-246 (1989); Chien et al., *Proc. Natl. Acad. Sci. USA,* 88:9578-9582 (1991)) as disclosed by Chevray and Nathans, *Proc. Natl. Acad. Sci. USA,* 89: 5789-5793 (1991). Many transcriptional activators, such as yeast GAL4, consist of two physically discrete modular domains, one acting as the DNA-binding domain, the other one functioning as the transcription-activation domain. The yeast expression system described in the foregoing publications (generally referred to as the "two-hybrid system") takes advantage of this property, and employs two hybrid proteins, one in which the target protein is fused to the DNA-binding domain of GAL4, and another, in which candidate activating proteins are fused to the activation domain. The expression of a GAL1-lacZ reporter gene under control of a GAL4-activated promoter depends on reconstitution of GAL4 activity via protein-protein interaction. Colonies containing interacting polypeptides are detected with a chromogenic substrate for β-galactosidase. A complete kit (MATCHMAKER™ for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

Compounds that interfere with the interaction of a gene encoding a TAT polypeptide identified herein and other intra- or extracellular components can be tested as follows: usually a reaction mixture is prepared containing the product of the gene and the intra- or extracellular component under conditions and for a time allowing for the interaction and binding of the two products. To test the ability of a candidate compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described hereinabove. The formation of a complex in the control reaction(s) but not in the reaction mixture containing the test compound indicates that the test compound interferes with the interaction of the test compound and its reaction partner.

To assay for antagonists, the TAT polypeptide may be added to a cell along with the compound to be screened for a particular activity and the ability of the compound to inhibit the activity of interest in the presence of the TAT polypeptide indicates that the compound is an antagonist to the TAT polypeptide. Alternatively, antagonists may be detected by combining the TAT polypeptide and a potential antagonist with membrane-bound TAT polypeptide receptors or recombinant receptors under appropriate conditions for a competitive inhibition assay. The TAT polypeptide can be labeled, such as by radioactivity, such that the number of TAT polypeptide molecules bound to the receptor can be used to determine the effectiveness of the potential antagonist. The gene encoding the receptor can be identified by numerous methods known to those of skill in the art, for example, ligand panning and FACS sorting. Coligan et al., *Current Protocols in Immun.,* 1(2): Chapter 5 (1991). Preferably, expression cloning is employed wherein polyadenylated RNA is prepared from a cell responsive to the TAT polypeptide and a cDNA library created from this RNA is divided into pools and used to transfect COS cells or other cells that are not responsive to the TAT polypeptide. Transfected cells that are grown on glass slides are exposed to labeled TAT polypeptide. The TAT polypeptide can be labeled by a variety of means including iodination or inclusion of a recognition site for a site-specific protein kinase. Following fixation and incubation, the slides are subjected to autoradiographic analysis. Positive pools are identified and sub-pools are prepared and re-transfected using an interactive sub-pooling and re-screening process, eventually yielding a single clone that encodes the putative receptor.

As an alternative approach for receptor identification, labeled TAT polypeptide can be photoaffinity-linked with cell membrane or extract preparations that express the receptor molecule. Cross-linked material is resolved by PAGE and exposed to X-ray film. The labeled complex containing the receptor can be excised, resolved into peptide fragments, and subjected to protein micro-sequencing. The amino acid sequence obtained from micro-sequencing would be used to design a set of degenerate oligonucleotide probes to screen a cDNA library to identify the gene encoding the putative receptor.

In another assay for antagonists, mammalian cells or a membrane preparation expressing the receptor would be incubated with labeled TAT polypeptide in the presence of the candidate compound. The ability of the compound to enhance or block this interaction could then be measured.

More specific examples of potential antagonists include an oligonucleotide that binds to the fusions of immunoglobulin with TAT polypeptide, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. Alternatively, a potential antagonist may be a closely related protein, for example, a mutated form of the TAT polypeptide that recognizes the receptor but imparts no effect, thereby competitively inhibiting the action of the TAT polypeptide.

Another potential TAT polypeptide antagonist is an antisense RNA or DNA construct prepared using antisense technology, where, e.g., an antisense RNA or DNA molecule acts to block directly the translation of mRNA by hybridizing to targeted mRNA and preventing protein translation. Antisense technology can be used to control gene expression through triple-helix formation or antisense DNA or RNA, both of which methods are based on binding of a polynucleotide to DNA or RNA. For example, the 5' coding portion of the polynucleotide sequence, which encodes the mature TAT polypeptides herein, is used to design an antisense RNA oligonucleotide of from about 10 to 40 base pairs in length. A DNA oligonucleotide is designed to be complementary to a region of the gene involved in transcription (triple helix—see Lee et al., *Nucl. Acids Res.,* 6:3073 (1979); Cooney et al., *Science,* 241: 456 (1988); Dervan et al., *Science,* 251:1360 (1991)), thereby preventing transcription and the production of the TAT polypeptide. The antisense RNA oligonucleotide hybridizes to the mRNA in vivo and blocks translation of the mRNA molecule into the TAT polypeptide (antisense—Okano, *Neurochem.,* 56:560 (1991); *Oligodeoxynucleotides as Antisense Inhibitors of Gene Expression* (CRC Press: Boca Raton, Fla., 1988). The oligonucleotides described above can also be delivered to cells such that the antisense RNA or DNA may be expressed in vivo to inhibit production of the TAT polypeptide. When antisense DNA is used, oligodeoxyribonucleotides derived from the translation-initiation site, e.g., between about −10 and +10 positions of the target gene nucleotide sequence, are preferred.

Potential antagonists include small molecules that bind to the active site, the receptor binding site, or growth factor or other relevant binding site of the TAT polypeptide, thereby blocking the normal biological activity of the TAT polypeptide. Examples of small molecules include, but are not limited to, small peptides or peptide-like molecules, preferably soluble peptides, and synthetic non-peptidyl organic or inorganic compounds.

Ribozymes are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see, e.g., Rossi, *Current Biology,* 4:469-471 (1994), and PCT publication No. WO 97/33551 (published Sep. 18, 1997).

Nucleic acid molecules in triple-helix formation used to inhibit transcription should be single-stranded and composed of deoxynucleotides. The base composition of these oligonucleotides is designed such that it promotes triple-helix formation via Hoogsteen base-pairing rules, which generally require sizeable stretches of purines or pyrimidines on one strand of a duplex. For further details see, e.g., PCT publication No. WO 97/33551, supra.

These small molecules can be identified by any one or more of the screening assays discussed hereinabove and/or by any other screening techniques well known for those skilled in the art.

Isolated TAT polypeptide-encoding nucleic acid can be used herein for recombinantly producing TAT polypeptide using techniques well known in the art and as described herein. In turn, the produced TAT polypeptides can be employed for generating anti-TAT antibodies using techniques well known in the art and as described herein.

Antibodies specifically binding a TAT polypeptide identified herein, as well as other molecules identified by the screening assays disclosed hereinbefore, can be administered for the treatment of various disorders, including cancer, in the form of pharmaceutical compositions.

If the TAT polypeptide is intracellular and whole antibodies are used as inhibitors, internalizing antibodies are preferred. However, lipofections or liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., *Proc. Natl. Acad. Sci. USA,* 90: 7889-7893 (1993).

The formulation herein may also contain more than one active compound as necessary for the particular indication being treated, preferably those with complementary activities that do not adversely affect each other. Alternatively, or in addition, the composition may comprise an agent that enhances its function, such as, for example, a cytotoxic agent, cytokine, chemotherapeutic agent, or growth-inhibitory agent. Such molecules are suitably present in combination in amounts that are effective for the purpose intended.

The following examples are offered for illustrative purposes only, and are not intended to limit the scope of the present invention in any way.

All patent and literature references cited in the present specification are hereby incorporated by reference in their entirety.

EXAMPLES

Commercially available reagents referred to in the examples were used according to manufacturer's instructions unless otherwise indicated. The source of those cells identified in the following examples, and throughout the specification, by ATCC accession numbers is the American Type Culture Collection, Manassas, Va.

Example 1

Determination of Type A, B and C Polypeptide Antigens Associated with Human Tumors of Glial Origin We herein demonstrate that antigens overexpressed by gliomas consist of 3 separate categories: type A antigens which are overexpressed in a set of tumors designated type A tumors, type B antigens which are overexpressed in a set of tumors designated type B tumors, and type C antigens which are overexpressed in both type A and type B tumors at roughly equivalent abundance. We note that type A tumors include tumors of both astrocytic and oligodendroglial character and included tumors of all histological grades. In contrast, type B tumors include only high grade (grade 3 and 4) astrocytic tumors. As high grade glial tumors are well known to have a poorer prognosis, our findings suggested that type A and type B antigens can be used to predict patient survival. These findings also suggest that type A and type B antigens can be used as diagnostic tools and as targets therapies including antibody based therapies.

As defined herein, a "type A antigen" is a protein or RNA (or any identifiable portion of the protein or RNA including postranslational modifications) that is detected in a set of type A glioma tumors (see below) at 1.5 fold or greater abundance than levels detected in a set of type B glioma tumors (see below). The difference in magnitude of expression in type A and type B tumors are generally detectable at a significance level of $p<0.05$ using a t test.

As defined herein a "type B antigen" is a protein or RNA (or any identifiable portion of the protein or RNA including postranslational modifications) that is detected in a set of type B glioma tumors (see below) at 3 fold or greater abundance than levels detected in a set of type A glioma tumors (see below). The difference in magnitude of expression in type A and type B tumors are generally detectable at a significance level of $p<0.01$ using a t test.

As defined herein, a "type C antigen" is a protein or RNA (or any identifiable portion of the protein or RNA including postranslational modifications) that is detected at higher levels in any set of gliomas at levels that are 3 fold or greater abundance than in normal brain, but which fails to meet either the criteria for type A or type B antigens.

"Type A glioma tumors" as defined herein are glioma tumors of astrocytic or oligodendroglial or mixed morphology of tumor grades I-IV (inclusive) which meet the following critieria. Each tumor included in this set must display overexpression of at least 5 fold as compared to a sample set of adult human brain of at least 3 of the following type A antigens: DNA246435 (TAT152), DNA297393 (TAT285), DNA266920 (TAT214), DNA92958 (TAT385), DNA35916 (TAT422), DNA225649 (TAT424), DNA226522 (TAT425), DNA256886 (TAT427), DNA340337 (TAT428), DNA334625 (TAT435), DNA226037 (TAT434), DNA330250 (TAT438), DNA255915 (TAT436), DNA226375 (TAT441) and DNA336054 (TAT443).

Additionally, type A antigens are molecules that are found in a subset of human gliomas and are expressed in the developing and/or adult nervous system at levels that exceed expression of these molecules in most other normal healthy tissues and organs. Many (but not all) type A antigens display expression in developing or adult nervous tissue at levels that exceed those seen in any other healthy organ, tissue or cell type. Many type A antigens are known to be associated with development or function of the nervous system. Type A antigens are typically either undetectable in established human glioma cell lines or present at levels well below what is seen in type A tumors. Type A antigens can be identified by comparing expression of RNA or proteins between type A tumors (or a set of tumors which includes type a tumors) and any one of a variety of comparator tissues including type B tumors, or tissue from adult brain or other organs. The hallmark of type A antigens is that they are more strongly expressed in type A gliomas than in type B gliomas and that they are markers associated with one or more of the following cell types or their precursors: neurons, astrocytes, and oligodgendroglia. Many, but not all, type A antigens are more strongly expressed in type A tumors than normal adult brain. We have focused on type A antigens that are overexpressed in type A tumors as compared to normal brain. We now include a class of type A marker that can be used to distinguish type A tumors from other gliomas, but do not necessarily distinguish type A tumors from normal brain. This specific class of type A marker can be identified by comparison of proteins or mRNAs differentially expressed between a group of type A tumors and a group of type B tumors.

Type A tumors include gliomas of varying grades (I-IV) of both astrocytic and oligodendroglial character and may include those of ependymal character as well. Among glial tumors, type A tumors are identified by high expression of one or more of the type A antigens listed below. In addition, type A tumors are distinguished by lower expression of most type B antigens than is detected in type B tumors. Type A tumors are identified by methods that detect the presence of RNA or protein corresponding to type A antigens and the demonstration that one or more of such type A markers is present at higher levels in these tumors than in a set of comparator tissues. The set of comparator tissues may be comprised of a set of non-type A glial tumors or of any of a variety of other tissues. The method of identifying type A tumors based on detection of one or more type A markers may be applied to identify individual type A tumors in a mixed population of glial tumors or to specify that a set of tumors that has been identified or sorted from a larger population of gliomas by other means is a group of type A tumors based on the presence of one or more type A antigens in one or more of the samples in that group. As an example of the first variation of the method, type A tumors could be identified by ranking a set of glial tumors for relative expression of one or more type A antigens or by hierarchical clustering of tumors based on a list of sequences that includes one or more type A antigens. As a specific example of the second variation of the method, a group of glial tumors sorted by similarity in expression of a large number of unspecified sequences could be identified as a set of group A tumors based on the expression of one or more type A markers in one or more tumors present in the sample set.

"Type B glioma tumors" as defined herein are gliomas of astrocytic morphology of tumor grades III or IV which meet the following criteria. Most commonly, type B tumors are grade 4 astrocytomas, known as glioblastoma. Each tumor included in the set of type B tumors must display overexpression of at least 10 fold as compared to a sample set of adult human brain of at least 3 of the following type B antigens: DNA273438 (TAT351), DNA225952 (TAT448), DNA266307 (TAT227), DNA98541 (TAT445), DNA227020 (TAT446), DNA92995 (TAT447), DNA225952 (TAT448), DNA226139 (TAT462), DNA271324 (TAT486), DNA226061 (TAT451), DNA 96911 (TAT452), DNA226121 (TAT453), DNA226651 (TAT454), DNA208684 (TAT459) and DNA182764 (TAT274). In addition, type B tumors must not display 5-fold or greater overexpression of more than one of the type A antigens listed above.

Additionally, type B antigens are molecules that are found in a subset of human gliomas, and are typically expressed in one or more tissues, organs, or cell types outside of the nervous system at levels that meet or exceed those seen in normal brain. Type B antigens are often expressed in tissues of mesenchymal origin including fibroblasts, connective tissues, bone, and cartilage or in elements of the immune system, notably cells of hematopoetic origin. Many type B antigens are extracellular matrix proteins, but other classes of molecule are represented as well. Many, but not all, type B antigens are expressed in some glioma cell lines at an abundance that meets or exceeds that seen in type B tumors. Type B antigens are markers that are not expressed at high abundance on developing or adult neurons, astrocytes, or oligodendroglial cells and typically have no known function in the development or function of these cell types. The hallmark of type B antigens is that they are more strongly expressed in type B tumors than type A tumors and that they are expressed in one or more normal tissues, organs, or cells outside of the nervous system at levels that are more abundant than in the normal brain. Type B antigens may show some expression in type A tumors that is increased relative to normal brain, but expression is less abundant than in type B tumors. Type B antigens may be identified by comparing expression of RNA or proteins between type B tumors (or a set of tumors which includes type a tumors) and any one of a variety of comparator tissues including type A tumors, or tissue from adult brain.

Type B tumors include only high grade (grade 3 & 4) astrocytomas. Among high grade astrocytomas, type B tumors are distinguished from non-type B tumors by virtue of their higher abundance of one or more type B markers. Type B tumors are identified by methods that detect the presence of RNA or protein corresponding to type B antigens and the demonstration that one or more of such type B markers is present at higher levels in these tumors than in a set of comparator tissues. The set of comparator tissues may be comprised of a set of non-type B glial tumors or of any of a variety of other tissues. The method of identifying type B tumors based on detection of one or more type B markers may be applied to identify individual type B tumors in a mixed population of glial tumors or to specify that a set of tumors that has been identified or sorted from a larger population of gliomas by other means is a group of type A tumors based on the presence of one or more type A antigens in one or more of the samples in that group. As an example of the first variation of the method, type B tumors could be identified by ranking a set of glial tumors for relative expression of one or more type B antigens or by hierarchical clustering of tumors based on a list of sequences that includes one or more type B antigens. As a specific example of the second variation of the method, a group of glial tumors sorted by similarity in expression of a large number of unspecified sequences could be identified as a set of group B tumors based on the expression of one or more type B markers in one or more tumors present in the sample set.

RNA or protein may be quantitatively detected by a variety of techniques including, but not limited to DNA arrays, Taqman real-time PCR, Northern blots, Western blots, or ELISA. Data analysis will compare the statistical means of values of RNA or protein detected across each sample group. Overexpression values are determined by creating a ratio of the means of the two sets of samples.

Using various techniques well known in the art (see, e.g., PCT/US02/41798, Yap, *Pharmacogenomics,* 3(5):709-711 (2002), Irizarry et al., *Nucl. Acids Res.* 31(4):e15 (2003), Chudin et al., *Genome Biology* 3(1):RESEARCH0005 (2002), and Takahashi et al., *Nippon Yakurigaku Zasshi—Folia Pharmacologica Japonica* 120(2):73-84 (2002), all of which are hereby incorporated by reference), we have been able to identify a variety of glial-tumor expressed polyopeptides that fall into the definition of "type A", type B" or "type C" glial tumor antigens as defined above. Many of the TAT polypeptides of the present invention have been identified as being overexpressed in human tumor(s) of glial origin as compared to normal glial and brain tissue. As such, the TAT polypeptides of the present invention are excellent targets for the diagnosis and therapy of tumors of glial origin in humans.

In order to further define the specificity of expression of the TAT polypeptides of the present invention in glial tumors, cluster analysis of glioma samples with and without normal brain samples was performed using the method described by Eisen et al., *Proc. Natl. Acad. Sci. USA* 95(25):14863-14868 (1998). This clustering analysis uses the Treeview Cluster program developed at Stanford University.

Cluster analysis on 29 tumor specimens using information from all sequences present on the gene arrays revealed 2 major classes of glioma tumor, referred to herein as Class A and Class B tumors. Class A tumors consist of both oligodendrogliomas and astrocytomas while Class B tumors were exclusively astrocytomas. To identify antigens overexpressed in tumors or glial origin as compared to normal brain, expression data from tumors was compared to that from normal brain samples.

Compared to normal brain and glial tissue, Type A and Type B tumors were revealed to abundantly overexpress one of two sets of TAT polypeptides. TAT polypeptide antigens that fall into "Type A" (see Table 7 below) are often overexpressed (as compared to normal brain and glial tissue) predominantly in Class A tumors and were found to cluster in a region of the Treeview gene cluster profile which is separate and distinct from where type B antigens generally cluster. Conversely, TAT polypeptides that fall into "Type B" are often overexpressed (as compared to normal brain and glial tissue) in predominantly Class B tumors and were located in a different region of the Treeview gene cluster profile than the TAT polypeptides of Type A. It should be noted that while each Class A or Class B tumor was often found to overexpress (as compared to normal brain and glial tissue) predominantly TAT polypeptides of Type A or Type B, respectively, many tumors showed evidence of a certain degree of overexpression of one or more TAT polypeptide(s) from the opposite group, although the degree of overexpression of these TAT polypeptide(s) (as compared to normal brain and glial tissue) from the opposite group tended to be lower.

In addition, a number of TAT polypeptides were identified that are overexpressed in both Class A and Class B tumors. These antigens, which are herein termed "Type C" antigens (see Table 7 below), were located in several different regions of the Treeview cluster profile performed with gliomas only.

Table 7 indicates the TAT polypeptides of the present invention which fall into each of Types A, B and C as described above as well as their cellular location (if known), wherein "ECM" means the TAT polypeptide is located in the extracellular matrix, "TM" means that the TAT polypeptide is a transmembrane polypeptide, "SEC" means that the TAT polypeptide is secreted by the tumor cells and "INT" means that the TAT polypeptide is an intracellular protein.

TABLE 7

| TAT Nucleic Acids and Polypeptides of Type A | Cellular Location |
|---|---|
| TAT152 - DNA246435 | ECM |
| TAT285 - DNA297393 | TM |
| TAT214 - DNA266920 | TM |
| TAT422 - DNA35916 | TM |
| TAT385 - DNA92958 | TM |
| TAT423 - DNA225643 | TM |

TABLE 7-continued

| | |
|---|---|
| TAT424 - DNA225649 | SEC |
| TAT425 - DNA226522 | TM |
| TAT426 - DNA225758 | SEC |
| TAT427 - DNA256886 | INT |
| TAT428 - DNA340337 | INT |
| TAT429 - DNA254942 | INT |
| TAT430 - DNA255505 | INT |
| TAT431 - DNA272284 | INT |
| TAT432 - DNA273088 | INT |
| TAT433 - DNA225556 | INT |
| TAT434 - DNA226037 | INT |
| TAT391 - DNA331171 | INT |
| TAT435 - DNA334625 | INT |
| TAT436 - DNA255915 | INT |
| TAT437 - DNA271568 | INT |
| TAT438 - DNA330250 | INT |
| TAT440 - DNA336053 | INT |
| TAT441 - DNA226375 | INT |
| TAT442 - DNA275290 | INT |
| TAT443 - DNA336054 | INT |

| TAT Nucleic Acids and Polypeptides of Type B | Cellular Location |
|---|---|
| TAT351 - DNA273438 | TM |
| TAT444 - DNA150906 | ECM |
| TAT227 - DNA266307 | ECM |
| TAT445 - DNA98541 | ECM |
| TAT446 - DNA227020 | TM |
| TAT447 - DNA92995 | ECM |
| TAT448 - DNA225952 | ECM |
| TAT449 - DNA225829 | TM |
| TAT450 - DNA226129 | ECM |
| TAT451 - DNA226061 | SEC |
| TAT452 - DNA96911 | ECM |
| TAT453 - DNA226121 | ECM |
| TAT454 - DNA226651 | ECM |
| TAT455 - DNA226968 | ECM |
| TAT456 - DNA226843 | TM |
| TAT457 - DNA242495 | ECM |
| TAT458 - DNA92981 | ECM |
| TAT459 - DNA208684 | SEC |
| TAT171 - DNA53971 | ECM |
| TAT460 - DNA226031 | TM |
| TAT461 - DNA82314 | ECM |
| TAT462 - DNA226139 | SEC |
| TAT463 - DNA226006 | ECM |
| TAT464 - DNA88323 | ECM |
| TAT465 - DNA304673 | ECM |
| TAT466 - DNA208684 | SEC |
| TAT467 - DNA188396 | TM |
| TAT468 - DNA33447 | SEC |
| TAT469 - DNA225520 | SEC |
| TAT274 - DNA182764 | TM |
| TAT470 - DNA226874 | TM |
| TAT471 - DNA227470 | TM |
| TAT262 - DNA88126 | ECM |
| TAT263 - DNA103464 | ECM |
| TAT472 - DNA88123 | |
| TAT473 - DNA88136 | ECM |
| TAT474 - DNA88125 | ECM |
| TAT475 - DNA88140 | ECM |
| TAT476 - DNA226895 | ECM |
| TAT477 - DNA88127 | |
| TAT478 - DNA219970 | TM |
| TAT479 - DNA125146 | ECM |
| TAT480 - DNA287307 | INT |
| TAT481 - DNA304872 | INT |
| TAT482 - DNA327641 | INT |
| TAT483 - DNA304666 | INT |
| TAT484 - DNA226460 | INT |
| TAT485 - DNA226479 | INT |
| TAT486 - DNA271324 | INT |
| TAT487 - DNA226619 | INT |
| TAT488 - DNA327052 | INT |
| TAT489 - DNA226162 | INT |
| TAT490 - DNA272963 | INT |
| TAT491 - DNA222844 | INT |
| TAT492 - DNA226473 | INT |
| TAT493 - DNA226892 | INT |
| TAT494 - DNA226895 | INT |
| TAT495 - DNA226822 | INT |

TABLE 7-continued

| | |
|---|---|
| TAT496 - DNA274759 | INT |
| TAT497 - DNA227115 | INT |
| TAT506 - DNA226447 | TM |
| **TAT Nucleic Acids and Polypeptides of Group C** | **Cellular Location** |
| TAT259 - DNA226027 | TM |
| TAT498 - DNA226069 | ECM |
| TAT273 - DNA19902 | TM |
| TAT265 - DNA288204 | TM |
| TAT278 - DNA226446 | TM |
| TAT499 - DNA50921 | TM |
| TAT500 - DNA119506 | SEC |
| TAT164 - DNA226094 | TM |

With regard to the above data, it is noted that the cellular location and type of protein that is indicated above will influence how it may best be used as a diagnostic and/or therapeutic target for the diagnosis and/or treatment, respectively, of tumors of glial origin. For example, for TAT polypeptides that are transmembrane proteins, are secreted proteins or are present in the extracellular matrix of the tumor, molecules that bind to such proteins such as, for example, antibodies, oligopeptides and organic molecules, may be routinely employed to quantitatively detect the presence of such proteins, to antagonize their biological function(s), to deliver growth inhibitory or toxic compounds to cells expressing those polypeptides and/or to kill cells expressing those polypeptides. For TAT polypeptides that are intracellular proteins, oligonucleotides (i.e., antisense oligonucleotides), small organic molecules and other molecules which are capable of being introduced into the intracellular space of a cell (including antibodies and oligopeptides), may be routinely employed to quantitatively detect the presence of such proteins, to antagonize their biological function(s), to deliver growth inhibitory or toxic compounds to cells expressing those polypeptides and/or to kill cells expressing those polypeptides.

Example 2

Additional Examples of Type A, B and C Glial Tumor Antigens

Using well known techniques as described in Example 1 above, additional molecules that fall into the above provided definitions of Type A, Type B or Type C glial tumor antigens were identified. More specifically, gene expression profiling of gliomas and normal brain tissue was performed on AFFYMETRIX™ U133A and U133B chips using techniques well known in the art. Sequences whose mean intensity value for expression was at least 5-fold greater in type A tumors compared to either type B tumors or normal brain and yielded a t-test value corresponding to P<0.00001 are listed below as new type A antigens. Sequences whose mean intensity value for expression was at least 10-fold greater in type B tumors compared to normal brain and yielded a t-test value corresponding to P<0.00001 are listed below as new type B antigens. The following are illustrative examples of such molecules and their classification, wherein the following lists are not intended to be comprehensive in nature. Other molecules falling into the definition of Type A, Type B or Type C glial tumor antigens not herein listed may be identified using the techniques and definitions disclosed herein without undue experimentation. The identification numbers shown below are probeset identification numbers from AFFYMETRIX™, wherein the complete cDNA sequences corresponding to the AFFYMETRIX™ probesets shown below can be obtained from files publicly available for download from the AFFYMETRIX™ website.

Additional Examples of Type A Antigens

223362_s_at, 226627_at, 204072_s_at, 235070_at, 37953_s_at, 205156_s_at, 203839_s_at, 213411_at, 226690_at, 228771_at, 221008_s_at, 219308_s_at, 209699_x_at, 202022_at, 226918_at, 209871_s_at, 225016_at, 221914_at, 235412_at, 235848_x_at, 213768_s_at, 209987_s_at, 209988_s_at, 214432_at, 204685_s_at, 214762_at, 213106_at, 225482_at, 239144_at, 205638_at, 221623_at, 219107_at, 91920_at, 226602_s_at, 230497_at, 229875_at, 223960_s_at, 218796_at, 60474_at, 230668_at, 228017_s_at, 228018_at, 230771_at, 229890_at, 223550_s_at, 220889_s_at, 62987_r_at, 234996_at, 210815_s_at, 213710_s_at, 228827_at, 205529_s_at, 205827_at, 226056_at, 204995_at, 231167_at, 225542_at, 239026_x_at, 231967_at, 228999_at, 204697_s_at, 204260_at, 224998_at, 230942_at, 235626_at, 229459_at, 237094_at, 229655_at, 227202_at, 211203_s_at, 227209_at, 229831_at, 236131_at, 232136_s_at, 223500_at, 227189_at, 244403_at, 205489_at, 240228_at, 205344_at, 212793_at, 204851_s_at, 204850_s_at, 229456_s_at, 219945_at, 219619_at, 229579_s_at, 223290_at, 229584_at, 225815_at, 228165_at, 226751_at, 223536_at, 223614_at, 213486_at, 224215_s_at, 219537_x_at, 222898_s_at, 228598_at, 228546_at, 228063_s_at, 228062_at, 237268_at, 232059_at, 240292_x_at, 228260_at, 238073_at, 206051_at, 228310_at, 222434_at, 230425_at, 210753_s_at, 226213_at, 236333_at, 235118_at, 241255_at, 227984_at, 231223_at, 240433_x_at, 242344_at, 232833_at, 230932_at, 228679_at, 242134_at, 229774_at, 240869_at, 238342_at, 239230_at, 229541_at, 229613_at, 229201_at, 229994_at, 241805_at, 228108_at, 243023_at, 231399_at, 235798_at, 236373_at, 230781_at, 230231_at, 227760_at, 238492_at, 239678_at, 239848_at, 236468_at, 229506_at, 230543_at, 226186_at, 236576_at, 236038_at, 235230_at, 227425_at, 229713_at, 228275_at, 238853_at, 231103_at, 238081_at, 229580_at, 230551_at, 237675_at, 229824_at, 242769_at, 231358_at, 229319_at, 230479_at, 240757_at, 228963_at, 239671_at, 228422_at, 230913_at, 240044_x_at, 241874_at, 228494_at, 238360_s_at, 229072_at, 235561_at, 232795_at, 228457_at, 243553_x_at, 240242_at, 235456_at, 236798_at, 241833_at, 229926_at, 229725_at, 226623_at, 227996_at, 239246_at, 230288_at, 227448_at, 227533_at, 229676_at, 219230_at, 225915_at, 226844_at, 227933_at, 221908_at, 226487_at, 219732_at, 219093_at, 235918_x_at, 230496_at, 235465_at, 230865_at, 241698_at, 238955_at, 238029_s_at, 239533_at, 231166_at, 229901_at, 227334_at, 238681_at, 239481_at, 231430_at, 203146_s_at, 227690_at, 229724_at, 227830_at, 205278_at, 243779_at, 234472_at, 236536_at, 226269_at, 227525_at, 225706_at, 225700_at, 227692_at, 231951_at, 222005_s_at, 205184_at, 228174_at, 236024_at, 239221_at, 206190_at, 215225_s_at, 227769_at, 209990_s_at, 217077_s_at, 211679_x_at, 209991_x_at, 224839_s_at, 236538_at, 205358_at, 238663_x_at, 213845_at, 227949_at, 228813_at, 226446_at, 222803_at, 209558_s_at, 38340_at, 218623_at, 219671_at, 226480_at, 214434_at, 220277_at, 227401_at, 228977_at, 204465_s_at, 229294_at, 239118_at,

211006_s_at, 207103_at, 223727_at, 228581_at, 205902_at, 244040_at, 205903_s_at, 205737_at, 214954_at, 205151_s_at, 209839_at, 243495_s_at, 232195_at, 227231_at, 223543_at, 232733_s_at, 226415_at, 232226_at, 222820_at, 230577_at, 236688_at, 227365_at, 237802_at, 236824_at, 226433_at, 236448_at, 229921_at, 205051_s_at, 229881_at, 227261_at, 231015_at, 206785_s_at, 204584_at, 228762_at, 226548_at, 226549_at, 228414_at, 228028_at, 232015_at, 227599_at, 228051_at, 232034_at, 226382_at, 236030_at, 214393_at, 235527_at, 236644_at, 227340_s_at, 232921_at, 238885_at, 238458_at, 228615_at, 226123_at, 229963_at, 244187_at, 225777_at, 225531_at, 226346_at, 238339_x_at, 210414_at, 230194_at, 226884_at, 241792_x_at, 227719_at, 225540_at, 205050_s_at, 225379_at, 206401_s_at, 232224_at, 223582_at, 228012_at, 230002_at, 229778_at, 219144_at, 224458_at, 224520_s_at, 227154_at, 241682_at, 230706_s_at, 236783_at, 223523_at, 223524 s_at, 228695_at, 229430 at, 227641_at, 238453_at, 228790_at, 221959_at, 232662_x_at, 224471_s_at, 205330_at, 235794_at, 226852_at, 209757_s_at, 210016_at, 213841_at, 242206_at, 230262_at, 229645_at, 244071_at, 237696_at, 230475_at, 238521_at, 238076_at, 235494_at, 226618_at, 213904_at, 214046_at, 229657_at, 226612_at, 226959_at, 235355_at, 235111_at, 228044_at, 228218_at, 227240_at, 229951_x_at, 229544_at, 226550_at, 215311_at, 228329_at, 216476_at, 225111_s_at, 227584_at, 224772_at, 224773_at, 229799_s_at, 214952_at, 217359_s_at, 214279_s_at, 206453_s_at, 224368_s_at, 241782_at, 201830_s_at, 201829_at, 230291_s_at, 226288_s_at, 209755_at, 231798_at, 238605_at, 204743_at, 213040_s_at, 225768_at, 209915_s_at, 228547_at, 209914_s_at, 209983_s_at, 209982_s_at, 229649_at, 225864_at, 236095_at, 229463_at, 232377_at, 205591_at, 228170_at, 213824_at, 213825_at, 207093_s_at, 214111_at, 235885_at, 225393_at, 228582_x_at, 227053_at, 214607_at, 228640_at, 228905_at, 232553_at, 204134_at, 205325_at, 229414_at, 226864_at, 213222_at, 215807_s_at, 230509_at, 236302_at, 228010_at, 202178_at, 227510_x_at, 204974_at, 223471_at, 219370_at, 206290_s_at, 235635_at, 229823_at, 204730_at, 210230_at, 241703_at, 206196_s_at, 213439_x_at, 224763_at, 224767_at, 224766_at, 206850_at, 225150_s_at, 243672_at, 224901_at, 219196_at, 229057_at, 210432_s_at, 204723_at, 204722_at, 223282_at, 222717_at, 229651_at, 231650_s_at, 213609_s_at, 211894_x_at, 223122_s_at, 205751_at, 227923_at, 227845_s_at, 228509_at, 210040_at, 229151_at, 205316_at, 204229_at, 204230_s_at, 213664_at, 219090_at, 57588_at, 227176_at, 213601_at, 222784_at, 222783_s_at, 202508_s_at, 202507_s_at, 204953_at, 237472_at, 213668_s_at, 201418_s_at, 226913_s_at, 235342_at, 213993_at, 209437_s_at, 213994_s_at, 228821_at, 203001_s_at, 203000_at, 221236_s_at, 228045_at, 219425_at, 229039_at, 230303_at, 213200_at, 203999_at, 226086_at, 223529_at, 206552_s_at, 238041_at, 225840_at, 204100_at, 35846_at, 202242_at, 223557_s_at, 214774_x_at, 216623_x_at, 215108_x_at, 228882_at, 230624_at, 228956_at, 228608_at, 243261_at, 237003_at, 239293_at, 203797_at, 228403_at, 226591_at, 230869_at, 229461_x_at, 228214_at, 227498_at, 230220_at, 227497_at, 241888_at, 235079_at, 231576_at, 223366_at, 213676_at, 230889_at, 226587_at, 228370_at

Additional Examples of Type B Antigens

208161_s_at, 221641_s_at, 200974_at, 211160_x_at, 208637_x_at, 202952_s_at, 222162_s_at, 209122_at, 202912_at, 209901_x_at, 213095_x_at, 215051_x_at, 212543_at, 223333_s_at, 221009_s_at, 201012_at, 208816_x_at, 213503_x_at, 201590_x_at, 210427_x_at, 215867_x_at, 224940_s_at, 205681_at, 204908_s_at, 201169_s_at, 209267_s_at, 219869_s_at, 210538_s_at, 212992_at, 217966_s_at, 217967_s_at, 212067_s_at, 208747_s_at, 221766_s_at, 218541_s_at, 203963_at, 210735_s_at, 204865_at, 201615_x_at, 201616_s_at, 200755_s_at, 208908_s_at, 203065_s_at, 212097_at, 216598_s_at, 214038 at, 205099_s_at, 203645_s_at, 215049_x_at, 210916_s_at, 217523_at, 204490_s_at, 204489_s_at, 212014_x_at, 216942_s_at, 205173_x_at, 209396_s_at, 209395_at, 216546_s_at, 213060_s_at, 221107_at, 209732_at, 219890_at, 208659_at, 211343_s_at, 212865_s_at, 202310_s_at, 202404_s_at, 202403_s_at, 215076_s_at, 201852_x_at, 211161_s_at, 211981_at, 221730_at, 221729_at, 209156_s_at, 204846_at, 201942_s_at, 201943_s_at, 201940_at, 208146_s_at, 201161_s_at, 221799_at, 204971_at, 201487_at, 210042_s_at, 204470_at, 218002_s_at, 222484_s_at, 209774_x_at, 207850_at, 214974_x_at, 209201_x_at, 211919_s_at, 221903_s_at, 202437_s_at, 202436_s_at, 210764_s_at, 201289_at, 209182_s_at, 209183_s_at, 214733_s_at, 204342_at, 213616_at, 203912_s_at, 203717_at, 204646_at, 217901_at, 210151_s_at, 31845_at, 203729_at, 201809_s_at, 208394_x_at, 222288_at, 236495_at, 228141_at, 238877_at, 203305_at, 222692_s_at, 218618_s_at, 203088_at, 241762_at, 203240_at, 210889_s_at, 211395_x_at, 211864_s_at, 201798_s_at, 202949_s_at, 212848_s_at, 204508_s_at, 214164_x_at, 218035_s_at, 219460_s_at, 218802_at, 218454_at, 219973_at, 235417_at, 214752_x_at, 213746_s_at, 207876_s_at, 212464_s_at, 218880_at, 203698_s_at, 203697_at, 203706_s_at, 213524_s_at, 202270_at, 202269_x_at, 202748_at, 203925_at, 208296_x_at, 210260_s_at, 204221_x_at, 209276_s_at, 206662_at, 201141_at, 242517_at, 228367_at, 220491_at, 214463_x_at, 212999_x_at, 209728_at, 203665_at, 208470_s_at, 206697_s_at, 214085_x_at, 205580_s_at, 205579_at, 213418_at, 201655_s_at, 204142_at, 236028_at, 202638_s_at, 203854_at, 201422_at, 210095_s_at, 212143_s_at, 203424_s_at, 201888_s_at, 206172_at, 202948_at, 203233_at, 205207_at, 205798_at, 202859_x_at, 211506_s_at, 200791_s_at, 201465_s_at, 222379_at, 212314_at, 211651_s_at, 201505_at, 208949_s_at, 205266_at, 218983_at, 218484_at, 204298_s_at, 215446_s_at, 203570_at, 219949_at, 202728_s_at, 202018_s_at, 201744_s_at, 205668_at, 206584_at, 213975_s_at, 208858_s_at, 213126 at, 214696_at, 204575_s_at, 204259_at, 209708_at, 201319 at, 219607_s_at, 214770_at, 201058_s_at, 202555_s_at, 213556_at, 214596_at, 208636_at, 202238_s_at, 202237_at, 39549_at, 207443_at, 212298_at, 210809_s_at, 217739_s_at, 243296 at, 217738_at, 205825_at, 213652_at, 41469_at, 217744_s_at, 203649_s_at, 215870_s_at, 221577_x_at, 205479_s_at, 211924_s_at, 210845_s_at, 203470_s_at, 202619_s_at, 201136_at, 202430_s_at, 212235_at, 204518_s_at, 203407_at, 204897_at, 204748_at, 208790_s_at, 208789_at, 206157_at, 209515_s_at, 222294_s_at, 210951_x_at, 204214_s_at, 213338_at, 213397_x_at, 209507_at, 212647_at, 200660_at, 203186_s_at, 202917_s_at, 203535_at, 213988_s_at, 204362_at, 212158_at, 202375_at, 202833_s_at, 211429_s_at, 212268_at, 202628_s_at, 202627_s_at, 200986_at, 207714_s_at, 221732_at, 217691_x_at, 204981_at, 221024_s_at, 216236_s_at, 202497_x_at, 209453_at, 205374_at, 203021_at, 213139_at, 206359 at, 215078_at, 215223_s_at, 216841_s_at, 221477_s_at, 202864_s_at, 218638_s_at, 217995_at, 205499_at, 204597_x_at, 205542_at, 202796_at, 204879_at, 221898_at, 205547_s_at, 204158_s_at, 205943_at, 201506_at,

201110_s_at, 201666_at, 204924_at, 201645_at, 202510_s_at, 202643_s_at, 202644_s_at, 206025_s_at, 206026_s_at, 218368_s_at, 204780_s_at, 215719_x_at, 204781_s_at, 203476_at, 204083_s_at, 216450_x_at, 219434_at, 203567_s_at, 218424_s_at, 209803_s_at, 209191_at, 213943_at, 205890_s_at, 203234_at, 201831_/s_at, 211527_x_at, 212171_x_at, 210512_s_at, 200628_s_at

Additional Examples of Type C Antigens

203505_at, 204416_x_at, 266_s_at, 216379_x_at, 201028_S_at, 224733_at, 204619_s_at, 205168_at, 218831_s_at, 219895_at, 211284_s_at, 211799_x_at, 211991_s_at, 201137_s_at, 208894_at, 215193_x_at, 203548_s_at, 202350_s_at, 223280_x_at, 224356_x_at, 223343_at, 204319_s_at, 202307_s_at, 209109_s_at, 219725_at, 204122_at

Example 3

Use of Type A and Type B Antigens for the Prognosis of High Grade Glioma and Predicting Response to Treatment We now show examples of the utility of type A and type B antigens in the classification of high grade astocytoma for purposes of predicting patient survival, disease progression, and potentially response to treatment.

Initially, using type A and type B antigen lists identified as described above, we identified a population of high grade glioma that shows relatively modest expression of both type A and type B markers. This population of tumors was found to show strong overexpression of a variety of markers of proliferation, including genes involved in DNA repair and replication. Such markers of proliferation (probeset identification numbers from AFFYMETRIX™ shown in parentheses) include, for example, top2a (201292_at), EZH2 (203358_s_at), cdc2 (203213_at), DHFR (202533_s_at), cdk2 (211804_s_at), kntc1 (206316_s_at) and smc411 (201663_s_at). Most tumors characterized by relatively low expression of type A and type B markers were seen to display high expression of these markers of proliferation. These findings demonstrate that the identification of high grade glioma tumors that display low expression of type A and type B markers can be used to select patients whose tumors may respond well to treatment with anti-mitotic agents including, but not limited to, chemotherapeutic agents. Patients suffering from such tumors could also be expected to respond well to treatments which include, for example, antibody-based therapies; antimitotic or antiproliferative agents; Apo2L/Trail or agents which bind and activate the cognate receptors DR4 and/or DR5; agents which inhibit signaling of or downstream from the following receptors EGFR, IGFR1, PDGFR, FLT, FLK & met; agents which inhibit the actions of the following ligands: EGF, IGF2, PDGF, VEGF, & HGF; agents which inhibit signaling in the beta catenin pathway, agents which inhibit signaling in the P13K/akt pathway including inhibitors of akt activity or of mTOR activity; agents which activate or inhibit signaling of notch and/or notch homologs; agents which antagonize CXCR4; agents which activate anti-tumor responses of the immune system, notably responses of microglial and hematopoetic cells; agents designed to inhibit invasiveness of tumor cells, notably agents designed to inhibit tumor cell migration and agents which promote differentiation of tumor cells especially into a state where neuronal markers are expressed.

Secondly, utilizing a list of 140 nucleic acid sequences, tumors were classified based upon results from unsupervised hierarchical clustering by a method similar to that described by Eisen et al., *Proc. Natl. Acad. Sci. USA* 95(25):14863-14868 (1998). Four sets of tumors were identified based on the similarities in expression of the 140 markers utilized. The sets of tumors, numbered 1-4, differed in their relative levels of expression of typeA antigens, typeB antigens, and markers of proliferation. Tumor subsets 1 and 4 demonstrated the highest relative expression of type A and type B antigens respectively and are comprised of type A and type B tumors respectively. Tumor subset 3 displayed low expression of both type A and type B antigens, but high expression of proliferative markers. Tumor subset 2 displayed intermediate levels of expression of type A markers and variable expression of type B antigens and markers of proliferation. The sets of tumors, numbered 1-4, were found to differ in their composition of grade 3 vs grade 4 tumors, and mean survival times of the patients. The tumor subsets defined by most extreme expression of type A vs. type B antigens, namely groups 1 and 4, differed markedly in the percentage of grade 3 vs. grade 4 tumors and in patient survival times. Tumor subset 1, which is comprised of type A tumors, contained predominantly grade 3 tumors and the patients associated with these tumor samples showed, on average, long survival times, relative to patients whose tumors were in groups 2-4. Tumors of group 4 were by definition type B tumors and almost exclusively grade 4 tumors, and patients whose tumors were classified as group 4 had, on average, shorter survival times than those whose tumors were classified as group 1. Of the 25 matched pairs of primary and recurrent tumors, 24/25 recurrent tumors were either assigned to the same group as their respective primary tumor or were assigned to a higher number group. Thus, our findings indicate that expression of type A, type B, and proliferation markers can be used to predict a pattern of disease progression.

Example 4

Quantitative Analysis of TAT mRNA Expression

In this assay, a 5' nuclease assay (for example, TaqMan®) and real-time quantitative PCR (for example, ABI Prizm 7700 Sequence Detection System® (Perkin Elmer, Applied Biosystems Division, Foster City, Calif.)), were used to find genes that are significantly overexpressed in glial cell-derived tumor or tumors as compared to normal brain tissue. The 5' nuclease assay reaction is a fluorescent PCR-based technique which makes use of the 5' exonuclease activity of Taq DNA polymerase enzyme to monitor gene expression in real time. Two oligonucleotide primers (whose sequences are based upon the gene or EST sequence of interest) are used to generate an amplicon typical of a PCR reaction. A third oligonucleotide, or probe, is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the PCR amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

The 5' nuclease procedure is run on a real-time quantitative PCR device such as the ABI Prism 7700™ Sequence Detection. The system consists of a thermocycler, laser, charge-coupled device (CCD) camera and computer. The system amplifies samples in a 96-well format on a thermocycler. During amplification, laser-induced fluorescent signal is collected in real-time through fiber optics cables for all 96 wells, and detected at the CCD. The system includes software for running the instrument and for analyzing the data.

The starting material for the screen was mRNA isolated from a various type A and type B glial tumors. The mRNA is quantitated precisely, e.g., fluorometrically. As a negative control, RNA was isolated from various normal adult brain tissues.

Using this technique, the molecules listed below have been identified as being significantly overexpressed (i.e., at least 2 fold) in a particular type of glial tumor as compared to their normal non-cancerous counterpart tissue and thus, represent excellent polypeptide targets for the diagnosis and therapy of glial cell-derived tumor in mammals: DNA226027, DNA226069, DNA19902, DNA288204, DNA226446, DNA182764, DNA273438, DNA225952, DNA150906, DNA227020 and DNA22606.

This Taqman analysis was then utilized to verify complementary expression of three pairs of type A and type B antigens (pair DNA246435 and DNA225952; pair DNA295801 and DNA150906 and pair DNA92958 and DNA225829). The data from these analyses demonstrate that in tumors where the type A antigen is significantly overexpressed as compared to normal brain (i.e., in a type A tumor), the corresponding type B antigens is either not significantly expressed or expressed at a lower level. Additionally, in tumors where the type B antigen is significantly overexpressed as compared to normal brain (i.e., in a type B tumor), the corresponding type A antigens is either not significantly expressed or expressed at a lower level.

Example 5

In Situ Hybridization

In situ hybridization is a powerful and versatile technique for the detection and localization of nucleic acid sequences within cell or tissue preparations. It may be useful, for example, to identify sites of gene expression, analyze the tissue distribution of transcription, identify and localize viral infection, follow changes in specific mRNA synthesis and aid in chromosome mapping.

In situ hybridization was performed following an optimized version of the protocol by Lu and Gillett, *Cell Vision* 1:169-176 (1994), using PCR-generated $^{33}$P-labeled riboprobes. Briefly, formalin-fixed, paraffin-embedded human tissues were sectioned, deparaffinized, deproteinated in proteinase K (20g/ml) for 15 minutes at 37° C., and further processed for in situ hybridization as described by Lu and Gillett, supra. A [$^{33}$-P] UTP-labeled antisense riboprobe was generated from a PCR product and hybridized at 55° C. overnight. The slides were dipped in Kodak NTB2 nuclear track emulsion and exposed for 4 weeks.

$^{33}$P-Riboprobe Synthesis 6.0 μl (125 mCi) of $^{33}$P-UTP (Amersham BF 1002, SA<2000 Ci/mmol) were speed vac dried. To each tube containing dried $^{33}$P-UTP, the following ingredients were added:

2.0 μl 5× transcription buffer 1.0 μl DTT (100 mM)

2.0 μl NTP mix (2.5 mM: 10μ; each of 10 mM GTP, CTP & ATP+10 μl $H_2O$)

1.0 μl UTP (50 μM)

1.0 μl Rnasin 1.0 μl DNA template (1 μg)

1.0 μl $H_2O$ 1.0 μl RNA polymerase (for PCR products T3=AS, T7=S, usually)

The tubes were incubated at 37° C. for one hour. 1.0 μl RQ1 DNase were added, followed by incubation at 37° C. for 15 minutes. 90 μl TE (10 mM Tris pH 7.6/1 mM EDTA pH 8.0) were added, and the mixture was pipetted onto DE81 paper. The remaining solution was loaded in a Microcon-50 ultrafiltration unit, and spun using program 10 (6 minutes). The filtration unit was inverted over a second tube and spun using program 2 (3 minutes). After the final recovery spin, 100 μl TE were added. 1 μl of the final product was pipetted on DE81 paper and counted in 6 ml of Biofluor II.

The probe was run on a TBE/urea gel. 1-3 μl of the probe or 5 μl of RNA Mrk III were added to 3 μl of loading buffer. After heating on a 95° C. heat block for three minutes, the probe was immediately placed on ice. The wells of gel were flushed, the sample loaded, and run at 180-250 volts for 45 minutes. The gel was wrapped in saran wrap and exposed to XAR film with an intensifying screen in −70° C. freezer one hour to overnight.

$^{33}$P-Hybridization

A. Pretreatment of Frozen Sections

The slides were removed from the freezer, placed on aluminium trays and thawed at room temperature for 5 minutes. The trays were placed in 55° C. incubator for five minutes to reduce condensation. The slides were fixed for 10 minutes in 4% paraformaldehyde on ice in the fume hood, and washed in 0.5×SSC for 5 minutes, at room temperature (25 ml 20×SSC+975 ml SQ $H_2O$). After deproteination in 0.5 μg/ml proteinase K for 10 minutes at 37° C. (12.5 μl of 10 mg/ml stock in 250 ml prewarmed RNase-free RNAse buffer), the sections were washed in 0.5×SSC for 10 minutes at room temperature. The sections were dehydrated in 70%, 95%, 100% ethanol, 2 minutes each.

B. Pretreatment of Paraffin-Embedded Sections

The slides were deparaffinized, placed in SQ $H_2O$, and rinsed twice in 2×SSC at room temperature, for 5 minutes each time. The sections were deproteinated in 20 μg/ml proteinase K (500 μl of 10 mg/ml in 250 ml RNase-free RNase buffer; 37° C., 15 minutes)—human embryo, or 8× proteinase K (100 μl in 250 ml Rnase buffer, 37° C., 30 minutes)—formalin tissues. Subsequent rinsing in 0.5×SSC and dehydration were performed as described above.

C. Prehybridization

The slides were laid out in aplastic box lined with Box buffer (4×SSC, 50% formamide)—saturated filter paper.

D. Hybridization $1.0\times10^6$ cpm probe and 1.0 μl tRNA (50 mg/ml stock) per slide were heated at 95° C. for 3 minutes. The slides were cooled on ice, and 48 μl hybridization buffer were added per slide. After vortexing, 50 μl $^{33}$P mix were added to 50 μl prehybridization on slide. The slides were incubated overnight at 55° C.

E. Washes

Washing was done 2×10 minutes with 2×SSC, EDTA at room temperature (400 ml 20×SSC+16 ml 0.25M EDTA, $V_f$=4 L), followed by RNaseA treatment at 37° C. for 30 minutes (500 μl of 10 mg/ml in 250 ml Rnase buffer=20 μg/ml). The slides were washed 2×10 minutes with 2×SSC, EDTA at room temperature. The stringency wash conditions were as follows: 2 hours at 55° C., 0.1×SSC, EDTA (20 ml 20×SSC+16 ml EDTA, $V_f$=4 L).

F. Oligonucleotides

In situ analysis was performed on a variety of DNA sequences disclosed herein. The oligonucleotides employed for these analyses were obtained so as to be complementary to the nucleic acids (or the complements thereof) as shown in the accompanying figures.

G. Results

In situ hybridization was conducted for mRNAs corresponding to DNA246435, DNA295801, DNA266920, DNA92958, DNA273438, DNA150906, DNA225952 and DNA226069 on glioma and normal brain specimens. The results from these analyses demonstrated that the corresponding mRNAs are all overexpressed in glioma samples of their respective glial tumor type as compared to normal brain.

For DNA246435 and DNA225952, an extensive series of tumor specimens was examined by in situ hybridization. Sections from the same regions of individual tumors were examined for expression of mRNA corresponding to both antigens. The data from these analyses demonstrated that in tumors where the type A antigen is significantly overexpressed as compared to normal brain (i.e., in a type A tumor), the corresponding type B antigens is not significantly expressed. Additionally, in tumors where the type B antigen is significantly overexpressed as compared to normal brain (i.e., in a type B tumor), the corresponding type A antigens is not significantly expressed.

Example 6

Use of TAT as a Hybridization Probe

The following method describes use of a nucleotide sequence encoding TAT as a hybridization probe for, i.e., diagnosis of the presence of a tumor in a mammal.

DNA comprising the coding sequence of full-length or mature TAT as disclosed herein can also be employed as a probe to screen for homologous DNAs (such as those encoding naturally-occurring variants of TAT) in human tissue cDNA libraries or human tissue genomic libraries.

Hybridization and washing of filters containing either library DNAs is performed under the following high stringency conditions. Hybridization of radiolabeled TAT-derived probe to the filters is performed in a solution of 50% formamide, 5×SSC, 0.1% SDS, 0.1% sodium pyrophosphate, 50 mM sodium phosphate, pH 6.8, 2×Denhardt's solution, and 10% dextran sulfate at 42° C. for 20 hours. Washing of the filters is performed in an aqueous solution of 0.1×SSC and 0.1% SDS at 42° C.

DNAs having a desired sequence identity with the DNA encoding full-length native sequence TAT can then be identified using standard techniques known in the art.

Example 7

Expression of TAT in *E. coli*

This example illustrates preparation of an unglycosylated form of TAT by recombinant expression in *E. coli.*

The DNA sequence encoding TAT is initially amplified using selected PCR primers. The primers should contain restriction enzyme sites which correspond to the restriction enzyme sites on the selected expression vector. A variety of expression vectors may be employed. An example of a suitable vector is pBR322 (derived from *E. coli*; see Bolivar et al., *Gene,* 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the TAT coding region, lambda transcriptional terminator, and an argU gene.

The ligation mixture is then used to transform a selected *E. coli* strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized TAT protein can then be purified using a metal chelating column under conditions that allow tight binding of the protein.

TAT may be expressed in *E. coli* in a poly-His tagged form, using the following procedure. The DNA encoding TAT is initially amplified using selected PCR primers. The primers will contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences are then ligated into an expression vector, which is used to transform an *E. coli* host based on strain 52 (W3110 fuhA(tonA) Ion galE rpoHts(htpRts) clpP(lacIq). Transformants are first grown in LB containing 50 mg/ml carbenicillin at 30° C. with shaking until an O.D.600 of 3-5 is reached. Cultures are then diluted 50-100 fold into CRAP media (prepared by mixing 3.57 g $(NH_4)_2SO_4$, 0.71 g sodium citrate.2H2O, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20-30 hours at 30° C. with shaking. Samples are removed to verify expression by SDS-PAGE analysis, and the bulk culture is centrifuged to pellet the cells. Cell pellets are frozen until purification and refolding.

*E. coli* paste from 0.5 to 1 L fermentations (6-10 g pellets) is resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution is stirred overnight at 4° C. This step results in a denatured protein with all cysteine residues blocked by sulfitolization. The solution is centrifuged at 40,000 rpm in a Beckman Ultracentifuge for 30 min. The supernatant is diluted with 3-5 volumes of metal chelate column buffer (6 M guanidine, 20 mM Tris, pH 7.4) and filtered through 0.22 micron filters to clarify. The clarified extract is loaded onto a 5 ml Qiagen Ni-NTA metal chelate column equilibrated in the metal chelate column buffer. The column is washed with additional buffer containing 50 mM imidazole (Calbiochem, Utrol grade), pH 7.4. The protein is eluted with buffer containing 250 mM imidazole. Fractions containing the desired protein are pooled and stored at 4° C. Protein concentration is estimated by its absorbance at 280 nm using the calculated extinction coefficient based on its amino acid sequence.

The proteins are refolded by diluting the sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes are chosen so that the final protein concentration is between 50 to 100 micrograms/ml. The refolding solution is stirred gently at 4° C. for 12-36 hours. The refolding reaction is quenched by the addition of TFA to a final concentration of 0.4% (pH of approximately 3). Before further purification of the protein, the solution is filtered through a 0.22 micron filter and acetonitrile is added to 2-10% final concentration. The refolded protein is chromatographed on a Poros R1/H reversed phase column using a mobile buffer of 0.1% TFA with elution with a gradient of acetonitrile from 10 to 80%. Aliquots of fractions with A280 absorbance are analyzed on SDS polyacrylamide gels and fractions containing homogeneous refolded protein are pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations. In addition to resolving misfolded forms of proteins from the desired form, the reversed phase step also removes endotoxin from the samples.

Fractions containing the desired folded TAT polypeptide are pooled and the acetonitrile removed using a gentle stream of nitrogen directed at the solution. Proteins are formulated into 20 mM Hepes, pH 6.8 with 0.14 M sodium chloride and 4% mannitol by dialysis or by gel filtration using G25 Superfine (Pharmacia) resins equilibrated in the formulation buffer and sterile filtered.

Certain of the TAT polypeptides disclosed herein have been successfully expressed and purified using this technique(s).

Example 8

Expression of TAT in Mammalian Cells

This example illustrates preparation of a potentially glycosylated form of TAT by recombinant expression in mammalian cells.

The vector, pRK5 (see EP 307,247, published Mar. 15, 1989), is employed as the expression vector. Optionally, the TAT DNA is ligated into pRK5 with selected restriction enzymes to allow insertion of the TAT DNA using ligation methods such as described in Sambrook et al., supra. The resulting vector is called pRK5-TAT.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg pRK5-TAT DNA is mixed with about 1 μg DNA encoding the VA RNA gene [Thimmappaya et al., *Cell,* 31:543 (1982)] and dissolved in 500 μl of 1 mM Tris-HCl, 0.1 mM EDTA, 0.227 M $CaCl_2$. To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 μCi/ml $^{35}$S-cysteine and 200 μCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of TAT polypeptide. The cultures containing transfected cells may undergo further incubation (in serum free medium) and the medium is tested in selected bioassays.

In an alternative technique, TAT may be introduced into 293 cells transiently using the dextran sulfate method described by Somparyrac et al., *Proc. Natl. Acad. Sci.,* 12:7575 (1981). 293 cells are grown to maximal density in a spinner flask and 700 μg pRK5-TAT DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 μg/ml bovine insulin and 0.1 μg/ml bovine transferrin. After about four days, the conditioned media is centrifuged and filtered to remove cells and debris. The sample containing expressed TAT can then be concentrated and purified by any selected method, such as dialysis and/or column chromatography.

In another embodiment, TAT can be expressed in CHO cells. The pRK5-TAT can be transfected into CHO cells using known reagents such as $CaPO_4$ or DEAE-dextran. As described above, the cell cultures can be incubated, and the medium replaced with culture medium (alone) or medium containing a radiolabel such as $^{35}$S-methionine. After determining the presence of TAT polypeptide, the culture medium may be replaced with serum free medium. Preferably, the cultures are incubated for about 6 days, and then the conditioned medium is harvested. The medium containing the expressed TAT can then be concentrated and purified by any selected method.

Epitope-tagged TAT may also be expressed in host CHO cells. The TAT may be subcloned out of the pRK5 vector. The subclone insert can undergo PCR to fuse in frame with a selected epitope tag such as a poly-his tag into a Baculovirus expression vector. The poly-his tagged TAT insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged TAT can then be concentrated and purified by any selected method, such as by $Ni^{2+}$-chelate affinity chromatography.

TAT may also be expressed in CHO and/or COS cells by a transient expression procedure or in CHO cells by another stable expression procedure.

Stable expression in CHO cells is performed using the following procedure. The proteins are expressed as an IgG construct (immunoadhesin), in which the coding sequences for the soluble forms (e.g. extracellular domains) of the respective proteins are fused to an IgG1 constant region sequence containing the hinge, CH2 and CH2 domains and/or is a poly-His tagged form.

Following PCR amplification, the respective DNAs are subcloned in a CHO expression vector using standard techniques as described in Ausubel et al., *Current Protocols of Molecular Biology*, Unit 3.16, John Wiley and Sons (1997). CHO expression vectors are constructed to have compatible restriction sites 5' and 3' of the DNA of interest to allow the convenient shuttling of cDNA's. The vector used expression in CHO cells is as described in Lucas et al., *Nucl. Acids Res.* 24:9 (1774-1779 (1996), and uses the SV40 early promoter/enhancer to drive expression of the cDNA of interest and dihydrofolate reductase (DHFR). DHFR expression permits selection for stable maintenance of the plasmid following transfection.

Twelve micrograms of the desired plasmid DNA is introduced into approximately 10 million CHO cells using commercially available transfection reagents Superfect® (Quiagen), Dosper® or Fugene® (Boehringer Mannheim). The cells are grown as described in Lucas et al., supra. Approximately $3\times10^7$ cells are frozen in an ampule for further growth and production as described below.

The ampules containing the plasmid DNA are thawed by placement into water bath and mixed by vortexing. The contents are pipetted into a centrifuge tube containing 10 mLs of media and centrifuged at 1000 rpm for 5 minutes. The supernatant is aspirated and the cells are resuspended in 10 mL of selective media (0.2 μm filtered PS20 with 5% 0.2 μm diafiltered fetal bovine serum). The cells are then aliquoted into a 100 mL spinner containing 90 mL of selective media. After 1-2 days, the cells are transferred into a 250 mL spinner filled with 150 mL selective growth medium and incubated at 37° C. After another 2-3 days, 250 mL, 500 mL and 2000 mL spinners are seeded with $3\times10^5$ cells/mL. The cell media is exchanged with fresh media by centrifugation and resuspension in production medium. Although any suitable CHO media may be employed, a production medium described in U.S. Pat. No. 5,122,469, issued Jun. 16, 1992 may actually be used. A 3 L production spinner is seeded at $1.2\times10^6$ cells/mL. On day 0, the cell number pH ie determined. On day 1, the spinner is sampled and sparging with filtered air is commenced. On day 2, the spinner is sampled, the temperature shifted to 33° C., and 30 mL of 500 g/L glucose and 0.6 mL of 10% antifoam (e.g., 35% polydimethylsiloxane emulsion, Dow Corning 365 Medical Grade Emulsion) taken. Throughout the production, the pH is adjusted as necessary to keep it at around 7.2. After 10 days, or until the viability dropped below 70%, the cell culture is harvested by centrifugation and filtering through a 0.22 μm filter. The filtrate was either stored at 4° C. or immediately loaded onto columns for purification.

For the poly-His tagged constructs, the proteins are purified using a Ni-NTA column (Qiagen). Before purification, imidazole is added to the conditioned media to a concentration of 5 mM. The conditioned media is pumped onto a 6 ml Ni-NTA column equilibrated in 20 mM Hepes, pH 7.4, buffer containing 0.3 M NaCl and 5 mM imidazole at a flow rate of 4-5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc-containing) constructs are purified from the conditioned media as follows. The conditioned medium is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 μL of 1 M Tris buffer, pH 9. The highly purified protein is subsequently desalted into storage buffer as described above for the poly-His tagged proteins. The homogeneity is assessed by SDS polyacrylamide gels and by N-terminal amino acid sequencing by Edman degradation.

Certain of the TAT polypeptides disclosed herein have been successfully expressed and purified using this technique(s).

Example 9

Expression of TAT in Yeast

The following method describes recombinant expression of TAT in yeast.

First, yeast expression vectors are constructed for intracellular production or secretion of TAT from the ADH2/GAPDH promoter. DNA encoding TAT and the promoter is inserted into suitable restriction enzyme sites in the selected plasmid to direct intracellular expression of TAT. For secretion, DNA encoding TAT can be cloned into the selected plasmid, together with DNA encoding the ADH2/GAPDH promoter, a native TAT signal peptide or other mammalian signal peptide, or, for example, a yeast alpha-factor or invertase secretory signal/leader sequence, and linker sequences (if needed) for expression of TAT.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant TAT can subsequently be isolated and purified by removing the yeast cells from the fermentation medium by centrifugation and then concentrating the medium using selected cartridge filters. The concentrate containing TAT may further be purified using selected column chromatography resins.

Certain of the TAT polypeptides disclosed herein have been successfully expressed and purified using this technique(s).

Example 10

Expression of TAT in Baculovirus-Infected Insect Cells

The following method describes recombinant expression of TAT in Baculovirus-infected insect cells.

The sequence coding for TAT is fused upstream of an epitope tag contained within a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the sequence encoding TAT or the desired portion of the coding sequence of TAT such as the sequence encoding an extracellular domain of a transmembrane protein or the sequence encoding the mature protein if the protein is extracellular is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4-5 days of incubation at 28° C., the released viruses are harvested and used for further amplifications. Viral infection and protein expression are performed as described by O'Reilley et al., *Baculovirus expression vectors: A Laboratory Manual*, Oxford: Oxford University Press (1994).

Expressed poly-his tagged TAT can then be purified, for example, by $Ni^{2+}$-chelate affinity chromatography as follows. Extracts are prepared from recombinant virus-infected Sf9 cells as described by Rupert et al., *Nature,* 362:175-179 (1993). Briefly, Sf9 cells are washed, resuspended in sonication buffer (25 mL Hepes, pH 7.9; 12.5 mM $MgCl_2$; 0.1 mM EDTA; 10% glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% glycerol, pH 7.8) and filtered through a 0.45 μm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% glycerol, pH 6.0), which elutes nonspecifically bound protein. After reaching A280 baseline again, the column is developed with a 0 to 500 mM Imidazole gradient in the secondary wash buffer. One mL fractions are collected and analyzed by SDS-PAGE and silver staining or Western blot with $Ni^{2+}$-NTA-conjugated to alkaline phosphatase (Qiagen). Fractions containing the eluted $His_{10}$-tagged TAT are pooled and dialyzed against loading buffer.

Alternatively, purification of the IgG tagged (or Fc tagged) TAT can be performed using known chromatography techniques, including for instance, Protein A or protein G column chromatography.

Certain of the TAT polypeptides disclosed herein have been successfully expressed and purified using this technique(s).

Example 11

Preparation of Antibodies that Bind TAT

This example illustrates preparation of monoclonal antibodies which can specifically bind TAT.

Techniques for producing the monoclonal antibodies are known in the art and are described, for instance, in Goding, supra. Immunogens that may be employed include purified TAT, fusion proteins containing TAT, and cells expressing recombinant TAT on the cell surface. Selection of the immunogen can be made by the skilled artisan without undue experimentation.

Mice, such as Balb/c, are immunized with the TAT immunogen emulsified in complete Freund's adjuvant and injected subcutaneously or intraperitoneally in an amount from 1-100 micrograms. Alternatively, the immunogen is emulsified in MPL-TDM adjuvant (Ribi Immunochemical Research, Hamilton, Mont.) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retro-orbital bleeding for testing in ELISA assays to detect anti-TAT antibodies.

After a suitable antibody titer has been detected, the animals "positive" for antibodies can be injected with a final intravenous injection of TAT. Three to four days later, the mice are sacrificed and the spleen cells are harvested. The spleen cells are then fused (using 35% polyethylene glycol) to a selected murine myeloma cell line such as P3X63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against TAT. Determination of "positive" hybridoma cells secreting the desired monoclonal antibodies against TAT is within the skill in the art.

The positive hybridoma cells can be injected intraperitoneally into syngeneic Balb/c mice to produce ascites containing the anti-TAT monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

Example 12

Purification of TAT Polypeptides Using Specific Antibodies

Native or recombinant TAT polypeptides may be purified by a variety of standard techniques in the art of protein purification. For example, pro-TAT polypeptide, mature TAT polypeptide, or pre-TAT polypeptide is purified by immunoaffinity chromatography using antibodies specific for the TAT polypeptide of interest. In general, an immunoaffinity column is constructed by covalently coupling the anti-TAT polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of TAT polypeptide by preparing a fraction from cells containing TAT polypeptide in a soluble form. This preparation is derived by solubilization of the whole cell or of a subcellular fraction obtained via differential centrifugation by the addition of detergent or by other methods well known in the art. Alternatively, soluble TAT polypeptide containing a signal sequence may be secreted in useful quantity into the medium in which the cells are grown.

A soluble TAT polypeptide-containing preparation is passed over the immunoaffinity column, and the column is washed under conditions that allow the preferential absorbance of TAT polypeptide (e.g., high ionic strength buffers in the presence of detergent). Then, the column is eluted under conditions that disrupt antibody/TAT polypeptide binding (e.g., a low pH buffer such as approximately pH 2-3, or a high concentration of a chaotrope such as urea or thiocyanate ion), and TAT polypeptide is collected.

Example 13

In Vitro Tumor Cell Killing Assay

Mammalian cells expressing the TAT polypeptide of interest may be obtained using standard expression vector and cloning techniques. Alternatively, many tumor cell lines expressing TAT polypeptides of interest are publicly available, for example, through the ATCC and can be routinely identified using standard ELISA or FACS analysis. Anti-TAT polypeptide monoclonal antibodies (and toxin conjugated derivatives thereof) may then be employed in assays to determine the ability of the antibody to kill TAT polypeptide expressing cells in vitro.

For example, cells expressing the TAT polypeptide of interest are obtained as described above and plated into 96 well dishes. In one analysis, the antibody/toxin conjugate (or naked antibody) is included throughout the cell incubation for a period of 4 days. In a second independent analysis, the cells are incubated for 1 hour with the antibody/toxin conjugate (or naked antibody) and then washed and incubated in the absence of antibody/toxin conjugate for a period of 4 days. Cell viability is then measured using the CellTiter-Glo Luminescent Cell Viability Assay from Promega (Cat# G7571). Untreated cells serve as a negative control.

Example 14

In Vivo Tumor Cell Killing Assay

To test the efficacy of conjugated or unconjugated anti-TAT polypeptide monoclonal antibodies, anti-TAT antibody is injected intraperitoneally into nude mice 24 hours prior to receiving tumor promoting cells subcutaneously in the flank. Antibody injections continue twice per week for the remainder of the study. Tumor volume is then measured twice per week.

The foregoing written specification is considered to be sufficient to enable one skilled in the art to practice the invention. The present invention is not to be limited in scope by the construct deposited, since the deposited embodiment is intended as a single illustration of certain aspects of the invention and any constructs that are functionally equivalent are within the scope of this invention. The deposit of material herein does not constitute an admission that the written description herein contained is inadequate to enable the practice of any aspect of the invention, including the best mode thereof, nor is it to be construed as limiting the scope of the claims to the specific illustrations that it represents. Indeed, various modifications of the invention in addition to those shown and described herein will become apparent to those skilled in the art from the foregoing description and fall within the scope of the appended claims.

SEQUENCE LISTING (190 sequences)

SEQ ID NO: 1 - DNA, 2558 bp, Homo sapiens
tgtggcactgcctgcgtacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaattgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgc

SEQ ID NO: 2 - DNA, 3268 bp, Homo sapiens
gggaggctgtgccaggcgagccggaggggtgctccgcgctcccccgccctccttccgggagcgaggatgcagactctgaaactggtgctgctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactcatttttatttttttaaaaatcattccattaaacatatttctaaataatagtaagtggtactaacaaaataaataataatttaatagccttagaaataaatgactgtatacttatacaggttgaaaaaaactcggtaggaataagttacctttttgtttactaatgttggtttcaaaaatactcagattcattttagttggctgacatctggaagtagttaacaactaaccagtggacttcaacaatcatttgctcccaggcttcccccatcatcaccctcaccacatatcctgctaatatccaacaacaaacaaatatttaatattgaaatagcccattgcctgagaatgaacacaagctaaaatacatgcaagggtacttaatggaagccaaaccatgttctatacctaaggagaaaacatggacatgtagaatgcttttattcatgtattcaaaatcagaacaaatcagtgtatatcactagaacatcagatggaggataacacaagaagtgatacagatcagggttcacttctcttaccctctctctgttaggaccacattcctattttagccaaatgtttctggtacgggccatcttttcaccataaatggcattatgtttcaaatggctaaaagcatattatgggtatgctcaaaggagtaaaacccaattcacagagatgtggcttttctaaagaaccaaattaagggaatacttagtatctacaactaaagtattagtcattctgaggattatttgttgctttaagtattagctccctactacatccataacaccctacttactaaatttaattacacacaacttttcaagaattcgtattttatttgaagggaggtacctgtctactttatctacaataaaaacaaagggtattggctttctctaatccatgcaaactacaaattccatcgggagtcctacatcactaacagtggtatgaacaaaactaagaaagtacttcctatccacatgtgaatgttttaaaaaagtttttgccataaaacctaagtgtaatttagcataccacagtgctctgaagatgggtcattgacgatgtaccatttgtatataggtaatacacatgtaaatcactaattgttaattaaatataagaagtaggtttttatctttttaaaaaaaaaacaaaaaaggtgactccctttctcattctgttctgttgtattgcgtccaaaagttgtgtgtaatttttttaaggtccaagaaatgtaaagaaatttgttggaatacctgaatttctgtaaaaaaataaaaataaaaataagattttgttacttaaaa

SEQ ID NO: 3 - DNA, 666 bp, Homo sapiens
ctcctgtataggcgggcaccatgggctcctgctccggccgctgcgcgctcgtcgtcctctgcgcttttcagctggtcgccgccctggagaggcaggtgtttgacttcctgggctaccagtgggcgcccatcctggccaactttgtccacatcatcatcgtcatcctgggactcttcggcaccatccagtaccggctgcgctatgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcc

SEQ ID NO: 4 - DNA, 2933 bp, Homo sapiens
tgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaattgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaaaaaaaaaaaaaaaaaaaaaaaaaaaaaaaaaaaaaaaaaaaaaaaaaaaaaaaaa

SEQ ID NO: 5 - DNA, 960 bp, Homo sapiens
  Unsure 404-475,502,510,517,531,546,552,559,569,575,583,590-591,702-751,785-786,791,814,826,846,886,897,932,939: Unknown base
gcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggtagcgacgccccttttccccccgctacacactgggcgcgctgggcagaggcagcacctgcttttnnnnnnnnnnnnnnnnnnnnnnnnnnnnnnnnnnnnnnnnnnnnnnnnnnnnnnnnnnnnnnnnnnnnnnnncgggcgtggccggcgctgcgctcttgntggtccangtgcgcngccgtggccaatcncaggatgctgggtcncgcttnctggttnggaccccggngccgtnagtccacncactccnngatgcactcaacaacctaaggacgcaggagggttcccggggatggtccgagctcgtccgtagattggaatcgccctgaagatgtagaccctcacagggagtgtatgtaatnnnnnnnnnnnnnnnnnnnnnnnnnnnnnnnnnnnnnnnnnnnnnnnnnntccgcacgtggagtcagagcgtggatttttgtanntgctnggtggtgcccagtctctgccccngaggctttgganttcaatcttgaaggggtgtnctgggggaactttactgttgcaagttgtaaataatggttntttatatcgtnttttttcgtcaccccatctctgatagaaacacctntaaaggntattattgtgagtcaaaaaaa

SEQ ID NO: 6 - DNA, 7944 bp, Homo sapiens
cacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtggggggactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaaaaaaaaaaaaaaaaaaaaaaaaaaaaaaaaaaa

SEQ ID NO: 7 - DNA, 4361 bp, Homo sapiens
tgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaaaaaaaaaaaaaaa

SEQ ID NO: 8 - DNA, 2669 bp, Homo sapiens
gcctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggcctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaggacacacggaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgcccaggggcagattgggtgtgacctctcca

SEQ ID NO: 9 - DNA, 2521 bp, Homo sapiens
gcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagagctccaccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccgccgccagcagcaccaccttccccaaagccaacaagcggaaaaaccagaacattggctataagctgggacacaggagggccccgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagcccagctcttcgtgatcgacaatggcgcggatgactggcggatagccatgacctacgagcgcatcctgtacatcagcctggagatgctggtgtgcgccatccaccccattcctggcgagtacaagttcttctggacggctcgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgcctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattaaaaaaaaaaaaa

SEQ ID NO: 10 - DNA, 1156 bp, Homo sapiens
cgcagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 11 - DNA, 1563 bp, Homo sapiens
atgggtagccgggcgcggggcggggccgcggggccgccgcttaaagaaacttgttgcgggtcccgcagcgggacccgagcctcggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcgcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctga

SEQ ID NO: 12 - DNA, 2298 bp, Homo sapiens
gttctagatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggtctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgcgggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcactcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgattttttaaaaaaaaaaaaaaa

SEQ ID NO: 13 - DNA, 2435 bp, Homo sapiens
ccctgaggcttttcggagcgagctcctcaaatcgcatccagattttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcgtcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgaccaccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagt

SEQ ID NO: 14 - DNA, 11649 bp, Homo sapiens
  Unsure 1402: Unknown base
gggtttggggagcaggaggcagacatgtgttgctttgcacgtcatctggtccttccacctggctgggcatgggatggtgacctcagctggaacatggggctcgagccagacctcagggtctccctgcgtgtagcccccaaccccaagcctgatccccaccggagacctgaacagccttggacatcatcggatcagggtgggaggtgccagcctctgccacctgacttccagtccctgtgcccctcccaccctgcccttgggcactcctgccctgcaggttcctcagaggggcaacccaaagccagagaggggcgggtcttgtcgggcctccagcctggacttcccagcccctctggggcagcatctgggtgccagacctcggttcctagggcctcgtttctccctctgggaacagccaaatggtggtccctgagactcaggacagaccaagaagaagccggatgacatggcaagccacacactgcgtcccctgagcaggacgggacagcccgactccatcctcccacctgcgactgagcccccacccctactcctgtcccagccgtgcccctggtgacatttgggtgggaggggaggggatgagggggcacctgggggtcagagaacaaatgacgggtgaatacatgtgtgtggccaggtggaggagggaggggaggagcaggtgggctggacagggccggtgtgaggaaggggctcaggctggcagggggaggtggcaagagggatgggctgccattggtggtctgagacaaaggcggagggaggaggcgagcgctgatgggaaaggaacaaagagggaaggggggcgtgaagggggttccggcgggagggccgagccgagggaggaggcgccggccagctggacagagggaggaggccaggccagagccagaagacggccagaggcacaaagaagccagcgcgctggcggagtcaagggatggggcagagactgccggggccagcagggaccagctgaaggctgcgcagggggtgcgggccacacaggtagccaccctgagctcagccaccgatggagggtcgtggggctgctgcggtgatggcggtgggcttgggtccatctgtcctgccgtttctgcacagcttaggtgtcacccactggccttcgtggtgttttcattgtccatcggcagggacagctggtggtctgtctgccccgcctgtctggctgtcagcctctgggcaggcttgcttttatgggggagggtcctgtctgtctgtctgtcgccctctctggctgtgagcctgggggtgctgggctggccagtcggcttgctgggttaggctgtcccagctgtctgagtgtttgtccggctgtcaggatgtgtcctgggggctgggaaggagaggccgacccatngtctgtcggtcgactggtcagttggacgttcagctgtctgtacgtctgtctgctggcccatctgtctccccttggggccacctctcactccacctgcccctctgcgccccggattgcctggccagcaccacgtgggcctgtacttgtccacaccagtgactcctgcctgagacccccccccaacccaggatcaggcaggacggctggggcttaggtcaggggccgtctgtccggaaggcatcaccgcgccctccccagaccatcagctgaaccctctgaccctgtgatcccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccattttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggacctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacaacctcttttctgcagaaaagctccagcaggcgctgccttcacccacggatctgcccaggctgaaggcacacgctcaatgccccacgtgccttctccaggaggaacgaaccagggtttgagggttgggtggatggagctcaaaaggaaaccccagccccaccacggatgacccatccctcccgtcccatccccagcatgggcaaggccagcctttctggcaaaaggagctgtcctcaactcagggccgctgtgagcaaagctgaccccagcccccacccccagttaacactgctgcttctctgaatgcatgtcaccctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaaaagggggtcatggatggctgaacaaaaagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtgctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtttctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgc

SEQ ID NO: 15 - DNA, 2842 bp, Homo sapiens
gtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgaccgtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagatgtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaaagaaaatgaactgccc

SEQ ID NO: 16 - DNA, 879 bp, Homo sapiens
ctcctcacagaagcctggagctgggcatccaagaagaagcagcctcatttgttttctggtgtcatcgtaggtggccacctatggcttttgggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattg

SEQ ID NO: 17 - DNA, 2368 bp, Homo sapiens
gcgagaagccccactgaagccgggcgcagggtctgggacgcagttgggagtgcaaagggctggctgagagccgcaggagcagcaggctgtggcccaggcctcctgggtgacaggccctgtctggcggggaacagggaccaagagacaacacagaagaggctggacctcgaacaggggcggctgcctcactccctacctgagccagccgagggggccaaggactttagagctgtttcctccggcataagagagacacttgctttccagggcagcaccctttatcggagaaggctctacagggaaggggtctttgcagcctggatggccatcccacattcctttaacggaggtctctaggcctcagagagaacccagagttagaaaggaggccagacggtccttgctgtccccctggggagagaggaagttgccgcctgctgccaggcccaggaggagctgggcctgcaatagtgggggacctggcccctgaggcagtggcggccatgtcacggccaggccacggtgggctgatgcctgtgaatggtctgggcttcccaccgcagaacgtggcccgggtggtggtgtgggagtgtctgaatgagcacagccgctggcggccctacacggccaccgtgtgccaccacattgagaacgtgctgaaggaggacgctcgcggttccgtggtcctggggcaggtggacgcccagcttgtgccctacatcatcgacctgcagtccatgcaccagtttcgccaggacacaggcaccatgcggcccgtgcggcgcaacttctacgacccgtcgtcggcgccgggcaagggcatcgtgtgggagtgggagaacgacggcggcgcatggacggcctacgatatggacatctgcatcaccatccagaacgcctacgagaagcagcacccgtggctcgacctctcatcgctaggcttctgctacctcatctacttcaacagcatgtcgcagatgaaccgccagacgcgccggcgccgccgtctgcgccgccgcctggacctcgcctacccgctcaccgtgggctccatccctaagtcgcagtcgtggcccgtgggtgccagctcgggccagccctgctcctgccagcagtgcctgctggtcaacagcacgcgcgccgtctccaacgtcatcctggcctcgcagcgtcgtaaggtgccccccgcgcccccgctgccgccgccgccgccacctggagggcctccaggcgcgcttgccgtgcgccccagcgccaccttcacaggcgccgcgctctgggcagcgcccgccgccggccccgccgagcccgcgccgcctcccggggcgcccccacggagcccgggcgcccccggcggagcgcgcaccccggggcagaacaacctcaaccggcccgggccccagcgcaccaccagcgtgagcgcgcgcgcctccatcccgccgggggtccccgcactcccggtgaagaacttgaatggtactgggccggtccatccggccctggcagggatgaccgggatactgctgtgcgcggccgggctgcccgtgtgcctgacgcgggcccccaagcccatcctgcacccgccgcccgtgagcaagagcgacgtgaagcccgtgcctggcgtgcccggggtgtgccgcaagaccaagaagaagcaccttaaaaagagtaagaatcccgaggatgtggttcgaagatacatgcagaaggtgaaaaacccacctgatgaggactgcaccatctgcatggagcgactggtcacagcatcaggctacgagggcgtgcttcggcacaagggcgtgcggcctgagctcgtgggccgcctgggccgctgtggccacatgtaccacctgctgtgcctcgtggccatgtactccaatggcaacaaggatggcagcctgcagtgccccacctgcaaggccatctacggggagaagacgggtacgcagccgcctgggaagatggagttccacctcatcccccactcgctgcccggcttccctgatacccagaccatccgcatcgtctatgacatccccacaggcatccagggccctgagcaccccaaccccgggaagaagttcaccgcaagaggattccctcgccactgctatctacccaacaacgagaaaggccggaaggtgctgcggctgctcatcacggcctgggagagaagactcatcttcactatcggcacgtccaacaccacgggcgagtcggacaccgtggtgtggaacgagatccaccacaagaccgagtttggatccaacctcacgggacacggctacccggacgctagctacctagacaacgtgctggctgagctcacagcccagggcgtatccgaggctgcaggcaaggcttgagg

SEQ ID NO: 18 - DNA, 2960 bp, Homo sapiens
gaattcgaggatccgggtaccatggcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacacacacacacaattctaggctagtttctggtcttatcattgagttacagcttagtgatgattttaagacaaaacaaacaaacaaaaaaaaaaaaaaaccatggtacccggatcctcgaattc

SEQ ID NO: 19 - DNA, 4306 bp, Homo sapiens
ctgcccctgggtctctgcgcctttgcatgagactttacggtaagccgctcctcccgcgcccccgcccccagccccgctcggcgatccccggcgccgtcgccaggcgctggccgtggtgctgattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacacgaggggctggaaaagggagatgaggagctgaggccagcactgtcctttcagcctgacccacctgcacccttcaccccaagtccccttccccgcctggccaaccaggacagccgccctgtctttaccagccccactccagccatggctgcggtacccactcagccccagtccaaggagggaccctggagtccggatccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtcaagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcggtgagtgcccaggggtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatggttctacaacagtcgcagcctggatggttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggatctctttcctttgcaggagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccggcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttggaaaaaaaa

SEQ ID NO: 20 - DNA, 1286 bp, Homo sapiens
ctccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagtt

SEQ ID NO: 21 - DNA, 1635 bp, Homo sapiens
cccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcaccttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctccccgccctttcttagagtgcagttcttagccctctagaaacgagttggtgtctttc

SEQ ID NO: 22 - DNA, 9417 bp, Homo sapiens
  Unsure 2990,3006,3050,3505,3536,3551,3671,3792,3879,3995,4772,5075,5080,5104,5178,5184,5276,5491,5528,5758,5841,5899,5932,5951,6307,6356,8221: Unknown base
cttattttttatgaatgtcggatagctgcaccagcttggtggggaaagggtttgatgaatagcacaaagacactggctgttccctggaggctgtccctttaaaggagaatcttagtttattctggggggaggggatgcacacattagagtaggaaagagggcttggaataaaatgaaaacactcccccttcatagtcattgtactgaaatgcaaagactgcttcctaagctggagatgctaaccttgggtagctccttctgttctcttcaaggggaattttgtcaggctatggattcatttacaactgttagtcatgtgggcatgtgtgaggaaacagatgccagttttaatgtatttagcccgaagttccaatttgataggagccactgtcagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggggcctggggtaaatttgccccgtttaaatttgcccaaacagttttccttttgtagaggggtgtttaaatatacagcaattaaaaagtttgtgtggggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccagaaaaaaaaaaaaaagccgaagaataatgttatttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgctttttttttcctgtaaacatagcccataatggcaaaaacaactaattttaattgaaggtcttgcttgccantcctgtgttggctttnaccaaatataaaaattcccttattccttggtaatggtgcaaatntttggaaaggcacagcatccaaaccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaagaaatactacaagacacccctgtaatggattggtggcaactgggtggcactgctgatgtgcactgtgtaggggggaacccagtggtggtggggtatctcaaatgcccctagacaagcttcagatgtctgtagctaccaaaaacattttcggttcaagaaaagtgagatgatggtagtactggtttctggtgaaattgaaaaaccccaaatgatgaggatctctttttgccccctctcctttttttgtaaacccattcaaaaccattaataagcccattttactaancccctatttctttctagaagctcagggtttncttagtgcctcccanaacattttgtagttaattgggaaaaagtgatacttggattagggggtgtgggcataaagaatggtgggaggcctgattttaaaattcaggccagaacccccaatgactccacccatagtntcactttaggtctcatttagtccatcacctttattttaagttgaggaagtggaggctggtaaagagcaggaccagaggaagaatccagatttccttatgcttgggcctcacactagctctntgagtatttccttgattgcggtatatgtactactagaaaataccaaatggatatattttctttaggataacctttgaaccaacaatnttcaataacaatagtacatcttccatcttacttttaatcgagtataaggaaatgtttctttatggccattttggagggagcaggggatgaggcttggcatagtccaaaatttaagnctccaataattaattgcattttaaattgttttaaattggcccactttcaaggcaattttttttgtgtgtctgtaactgagctcctccacccctgtcattcacttccaattttacccaatccaattttagcactcaagttccattgtgttaatttttgcacggtctacacacatcaagtcagcaagcatttgccaccactccctatacttctccctcttttttacacacacacacacacacacacacacaatccatctcttgcttgttcctacctccctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgtttttctagctgaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatncacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccanagtanaaaaaagaaagagtggaacaatanctttgttcatcctaactttctgagatggcttttcaacatttaaaaaaaactagtgtggtaccattcactggcangatttnttttagaatatgggagtaagatgaggtagagaaaataacctggtctcactgtggttgccctcatccacaatgtccccaaagccatcctgctntgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctnttcctgggaactaagggggtatttattagttcagttntaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctttagtccaagtcttagaccagtgattggtgcttaccttgaacaaaattttgtctgtgttcctaatcccttcaatactntgggtacaatgctcccaatcaccctgcacatttgattctaaatggcttttattttttaaaaatccatatccctaggacaaganaacaggatgcctatatccccaaaatgagctccaggacactgatgggaatgatcccaangatcaccccacctcagaaaacgtctgtgccaanagacttccccagatagaancactgggacagtggtttgaacgacttcttttatggttgtccagtttgctatggaaataaaaggcattgattttttaaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccaaaaattgtttttgtctccaaaagtctagtatggtctttatacacccanactcttagtgttgcgtcctgccttgtttccttgttaaggatctatgcanacctcccgctttggcttagctagcgtgacattggctatcatttgacaagactaacttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagcaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagactttgaaggcattagcgtttctcattacttaggtcaataaccttgagggaatcaatggcttttttgccgctctacctctttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtggggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagaattgcaaagcccttggaaatgtcactgcttggcaataccatatggcatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagtctttaaaatgtttttgatcacctttntgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtattggccattgattacattcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaat

SEQ ID NO: 23 - DNA, 3655 bp, Homo sapiens
gttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgaagagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttttaggacatcttttgatacctttaaaagaaccactgtcaagtaatccttaaaaaaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgc

SEQ ID NO: 24 - DNA, 4960 bp, Homo sapiens
gtggctttgggtccccaggattctggatcgtggttgcatctggagagaaaaaaggatcaatcgacacgttttagaagtgtccgtgggtgaataaaaaaggagggggggggtgcaaaactggggttgcggatgcttaaagcaaaaaaagagaaaaggaagcgtcttgaatcctggaacaagaattaccgggtgctcgagatttcaaaaaagcgtctagaaactggtaaatacttggaccatttcagcttgaatttgacggcgaagtgttgtagagaccgtctccttgaatcattgcaaagggaccggggaaagatgagggggctccctctgtggatttatcttgctgagggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtccgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaatttcctgtttttaatgttcttttcaatcccatctagataatttatagaaatataaccctaattggacatgtggtagaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttct

SEQ ID NO: 25 - DNA, 1038 bp, Homo sapiens
ggcacgaggctcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacacaaaaaaaaaaaaaaaaaaaaaaaa

SEQ ID NO: 26 - DNA, 1371 bp, Homo sapiens
atgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcgtccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctag

SEQ ID NO: 27 - DNA, 2500 bp, Homo sapiens
cggggggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggc

SEQ ID NO: 28 - DNA, 8816 bp, Homo sapiens
aaaggcaatttaccagtgatttctgggtgctggggctgatattttttgtgcatatttaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgcctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaactacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaacgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagttcctctggctgactctatctgtagccacatggggacctgcctacgtgtgaacaaaatgaactgcacttatcacacaaggatttctttgaagacatgctactggggtgggaagcagtgaggttttattccccatctcctaactacagggagctctgccatgtcattttggccttcctgaaactaggacaggttgtctatcggggggcttcccccagagaggtttagtgggagaatgtcagtgaatgggatagttcacctcatgggacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaaaaaaaaaaaaaaatagccatatggaatggaaggaaaaggagaaaagaaggaagaaaggaaaaaagtaggaagggagagagaaaaaaaaggtcgctttgcggatacgagccgctaggctgacaacttttctatttcattggcagatatgaagcagtgtcttttccagtaaggtacggaagctttgttgttttcatgtgtacccagctcagccttttagaagcacctcggtttgcttcattaggtatttgatactctccagccttgtcctcaggcctgatttgatttgccagggtcctgacaccaaagcccaggccaagttctaaattcaggtgtgggctcacagtgctattgagcttgtcgaattctggcctcccctgaacattagccccacgggagcctgagggtgtttgaaaagggcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgaca

SEQ ID NO: 29 - DNA, 2163 bp, Homo sapiens
  Unsure 2118,2136: Unknown base
tttgctgtccggctgcctakggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggyttcattggtggaatcatcgttgtggttatgcgaaaaatgtcgggaaggccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaagaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattayatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggattttttttttttttttcctaaacaaagtttttacactgagcagatgctctgtcatgatggcggttgtgcaattctggtatcctctaaatttgtaagcattcataaaaaaaaaaaaaaaaaactcgagggggggcccggwcccaattgccctatagggagtcgtattacaattcactgsccgcgttttacaacgtcgngactgggaaaaccctggngttacccaacttaatcgccttgcagaa

SEQ ID NO: 30 - DNA, 1500 bp, Homo sapiens
tcacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatggacactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggatggcctttggatctctcttccaagcctttcctgacttcctcttagatcatagattggacctggttttgttttcctgcagctgttgacttgttgccctgaagtacaataaaaaaaattcattttgctccagta

SEQ ID NO: 31 - DNA, 2450 bp, Homo sapiens
cccttgagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaagggc

SEQ ID NO: 32 - DNA, 1809 bp, Homo sapiens
gagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcactgtgtttgacttcttgtgaaatttctgtactttgtatataaaatacataaaacaatagattagaaatc

SEQ ID NO: 33 - DNA, 817 bp, Homo sapiens
gaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaaataaaactttaacggcgg

SEQ ID NO: 34 - DNA, 946 bp, Homo sapiens
ccgggtcgactactactactactaaattcgcggccgcgtcgaccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagtttcgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 35 - DNA, 1925 bp, Homo sapiens
agtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccattcctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaaccctcggccagcaggtcccctatgccaccaagggcaaccagtgggtaggatacgacgaccaggaaagcgtcaaaagcaaggtgcagtacctgaaggataggcagctggcaggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgatgattaatggaaatgtttacagatccccaagcctggcaagggaatttcttcaactccctgccccctagccctccttatcaaaggacaccattttggcaagctctatcaccaaggagccaaacatcctacaagacacagtgaccatactaattataccccctgcaaagccagcttgaaaccttcacttaggaacgtaatcgtgtcccctatcctacttccccttcctaattccacagctgctcaataaagtacaagagtttaacagtgtgttggcgctttgctttggtctatctttgagcgcccactagacccactggactcacctcccccatctcttctgggttccttcctctgagccttgggacccctgagcttgcagagatgaaggccgccatgtt

SEQ ID NO: 36 - DNA, 1794 bp, Homo sapiens
cccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcatgtggtgattccccggatccaccccaactccatctgtgcagcaaacaacacaggggtgtacatcctcacatacaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttgtaaattagggcccaattaataatcagcaagaatttgatcgttcagttccacttggaggccttcatcctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttggggtgtactagttacacatcttcaacagaccccctctagaaatttttcagatgcttctgggagacaccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttc

SEQ ID NO: 37 - DNA, 7560 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgaatccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtttggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcggctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattggagggaccactgggtgagagaggaataaggcggcccagagcgaggaaaggattttaccaaagcatcaatacaaccagcccaaccatcggtccacacctgggcatttggtgagaatcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgaaaaaaaaccggaattc

SEQ ID NO: 38 - DNA, 2376 bp, Homo sapiens
cgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtgg

SEQ ID NO: 39 - DNA, 2697 bp, Homo sapiens
gcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctcctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacataaa

SEQ ID NO: 40 - DNA, 1108 bp, Homo sapiens
gagtgagtgagagggcagaggaaatactcaatctgtgccactcactgccttgagcctgcttcctcactccaggactgccagaggctcactcccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggctggggatataacaaacaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggaggagacaatggagaagaaggggaagaagaaagtgtcactggagccaatgcagaaggcaccacagagaccggagggcagggcaagggcacctcgaagacaacaacctctccaaatggtgggtttgaacctacaaccccaccacaagtctatagaaccacttccccaccttttgggaaaaccaccaccgttgaatacgagggggagtacgaatacacgggcgtcaatgaatacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctg

SEQ ID NO: 41 - DNA, 2328 bp, Homo sapiens
gccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggccctggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtaggcagcgtgtaccggcccaaccagaacggccgcggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccctgctccccgggcagcctcccgccgaggggcccagcccccaacccacaggcagggaggggcatccctccctgccggcctcagggagcgaacgtggatgaaaaccacagggattccggatgccagaccccattttatacttcacttttctctacagtgttgttttgttgttgttggtttttattttttatactttggccataccacagagctagattgcccaggtctgggctgaataaaacaaggtttttct

SEQ ID NO: 42 - DNA, 3432 bp, Homo sapiens
actccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctatgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctgccggccgtggtgagttgtgtgcctgggcaggtcttcagccctgacggaccctcgagattccggaaagcatacaagccagagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcatgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctctccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatg

SEQ ID NO: 43 - DNA, 829 bp, Homo sapiens
agttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttcacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcaccagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacgaatttatgaattgaattatcttggttgaaaataaaaagatcactttctcagttttcataagtattatgtctcttctgagctatttcatctatttttggcagtctgaatttttaaaacccatttatatttctttccttacctttttatttgcatgtggatcaaccatcgctttatt

SEQ ID NO: 44 - DNA, 12667 bp, Homo sapiens
ggccagcagccagctcccccgcgcgccggactctcggggcgacacgtgcgggcctccggccgccgagcggaggcgagccgggcggaggcgcggcggccaggagcggcgaccagggaccgcagcgctgcccgcgcccggccggccgctcactcccggcccgctcctctgcgtcggcagcgccgcgtcgtaggagcgcgagggccgcggccggggatgagctgactgcagtgagagcgtcgccccggcccccgccaggccgcccgctgccatctccgcgccgccctgccagccgcgatcatgtccatccacatcgtggcgttggggaacgagggcgacacgttccaccaggacaaccggccgtcggggctcatccgcacatacctgggaagaagcccgctggtgtcgggggacgagagtagcttgttgctgaacgcggccagcacggtcgcgcgcccggtgttcactgagtaccaggccagtgcgttcgggaacgtcaagctggtggtgcacgactgtcccgtcagggacatgtctgatctgcgggcggcgccgagcgagccagcgaacgaggccgggccatggggcagcgggcagtgggctcgttgctgctggggctgctgctgcacgcgcggctgctagcggtgacgcatgggctgagggcctacgatggcctttccctccctgaggacacagagactgtcacagcgagccggtatggctggacctactcatacctctctgatgatgaggacctgctggcagatgatgcatcaggagatggccttggcagcggagatgtgggcagcggggacttccagatggtctatttccgggctctggtaaattttacgcggtccattgagtacagcccccagctggaggatgcaagtgccaaggagttccgagaggtgtcggaggctgtggtagaaaagctggagcccgaatacaggaagatccccggagaccagattgtcagtgtggtgttcatcaaggaactggatggctgggtctttgttgagctggatgttggctccgaagggaatgcggacggatctcagattcaagaggtgctgcatacagtggtctccagtggctccatcggcccctatgtcacctccccctgggggttcaagttccgacgcctgggcacagtgccccagttcccaagagtctgcacggagacggagtttgcttgccacagctataatgagtgtgtggctctggagtatcgttgtgaccggaggcctgactgcagggacatgtctgatgaactcaactgtgaggaaccagtccccgagctcagctcctcgacacctgctgtggggaaggtgtcacctttaccactctggccagaagcagccacaacacctccaccgccagtcacgcatggacctcagtttctgttacccagtgttcctgggccctcagcctgtgggccccaggaggcctcgtgccacagcggacactgcatcccccgagactacctctgtgatggacaggaagactgcagggatggcagtgacgaactgggctgtgcgtcccctccaccctgtgagcctaacgagttcgcctgtgaaaatgggcactgtgctctcaagttgtggcgctgtgacggtgactttgattgtgaggaccggacagatgaggccaattgttctgtcaagcagcctggagaagtatgtgggcccacgcacttccagtgtgtctccaccaaccgctgcatcccagccagcttccactgtgacgaggaatccgactgtcccgaccgcagtgatgagtttggctgcatgcctccccaggtagtgacgcctccacagcagtccatccaggcttcccggggccagacagtgactttcacctgcgtagccactggtgtccccacacccatcatcaactggaggctcaactggggccacatccctgctcatcccagggtgacaatgaccagcgagggtgggcgtggcacgctgatcatccgtgacgtgaaggaggcagaccagggcgcatacacctgtgaggccatgaactcgcgtggcatggtgttcggcattccagacggcgtgctggagcttgtcccgcagcgagggccctgccctgacgggcacttctacctggaagacagtgcctcctgcctgccctgcttctgctttggtgtgaccaacgtgtgccagagcagcctgcgcttccgggaccagatccgactgagctttgaccagcccaatgacttcaagggtgtgaatgtgacgatgccctcccagcctggcgtgccacccctctcctccacccagctgcagatcgaccccgccctgcaggagttccagctggtcgacctgtctcgccgcttccttgtccacgatgctttctgggccctacccaagcagtttctgggcaacaaggtggactcctatggaggcttcctgcgctacaaggtgcgctatgaactggcacgaggcatgctggagccagtgcagaaaccagatgtgatccttgtgggtgcggggtaccgcctacactctcgaggccacacccccacccatcctggaactctgaaccagcgtcaggtccagctctcagaggaacactgggtccacgagtctggccggcctgtccagcgggctgagatgctgcaggccctggcgagcctggaggctgtcctgctacagacagtatataacaccaagatggccagtgtgggactgagtgacattgtcatggacaccactgtcacccataccaccatccatggccgggctcacagtgtggaggagtgcagatgccccattggctattctggtttgtcttgcgagagctgcgatgcccacttcacccgagtgcctggtgggccctacctgggtacttgctctggctgtaattgcaatggccatgccagctcctgtgaccctgtctacggccactgcctgaattgccagcacaacacagaaggacctcagtgtgacaagtgtaagcctggcttctttggagatgccacaaaggccacagccactgcctgccggccctgtccctgcccatacatcgacgcttcccgaaggttctcagacacttgcttcctggacacagacggccaagccacttgcgacgcttgtgccccaggttacacaggccgccgctgtgagagctgtgcccctggatatgaaggcaaccccatccagcctggcgggaagtgcaggcccaccacccaggaaattgtgcgctgtgatgagcgagggagcctgggcacctcaggggagacttgccgctgtaagaacaacgtagtggggcgcttgtgcaacgagtgctcggacggctcgttccacctgagcaagcaaaacccggacggctgcctcaagtgcttttgcatgggagtcagtcgccagtgcagcagctcctcctggagccgcgcccaggtgctcggggcctcggaacagccctctcagttcagcctgagcaacgccgctggcacccacaccaccagcgagggggtctcgtcccctgcacccggggagctgtcgttctcttccttccacaacctcctgtctgaaccctacttctggagtcttcccgccagcttccgaggggacaaggtgacgtcctacggcggagagctgcgcttcactgtgatgcagaggccccggcccagttctgcgcccctgcacagacagcccctggtggtgttgcagggcaacaacattgtgttggagcatcatgcctcgagggatcccagccctggccagcccagcaacttcatagtgcccttccaagagcaagcgtggcagcggcctgatgggcagccggccacacgggagcacctgctgatggccctcgcaggcattgatgccctcctcatccaagcatcttacacgcagcaaccggctgagagcaggctctctggtatcagcatggatgtggctgtgccagagaacactggccaggactcagcccgggaagtagagcagtgtacctgcccccctggttaccgcggcccttcctgccaggactgtgacacaggttacacacgcgtgcctagcgggctctacctgggcacctgtgagcgctgtaactgccatggccactcagagacctgtgagcctgagacaggggcgtgccagagctgccagcaccacacggagggtgctagctgtgaacagtgccagccagggtactatggggatgcccaacggggcacaccacaggactgccagccctgcccatgctacggagcccctgctgctggccaagctgcccacacttgtttcctggacacagatggccaccccacctgtgactcatgctcaccaggacacagcgggcgtcactgtgagaggtgtgccccaggttactatggcaaccccagccagggccagccctgccacagagatggtcaggtgccagaggtgctgggctgtggctgtgacccccatggcagcatcagcagccagtgtgacgccgctggtcagtgccagtgcaaggcccaggtggagggccgttcttgcagtcactgccgacctcaccacttccacctgagtgccagcaacccggaaggctgcctgccctgtttctgcatgggtgtcacccagcagtgcgccagctcctcttactcccgccagctgatctctacccactttgctcctggggacttccaaggctttgctctggtgaaccctcaacgcaacagccaactgacagggggcttcaccgtggaaccagtgcacgatggggcccgcctctctttcagcaactttgcccacctcggccaagagtccttctactggcagctgccagaaatataccaaggagacaaggtggcagcctatggcgggaagctgcggtacaccctctcctacacagccgggccacagggcagcccactcttggaccctgatatccagattacgggcaataacatcatgttggtggcttcccagccagcactacagggcccagagaggaggagctatgagatcatcttccgagaggagttctggcggcggccagatggacagcctgcgacccgagagcatttgctcatggccctggcagatctggatgaacttctggtgcgggccacattctcctctgtgccacgggcagccagtatcagtgccgtgagcctagaaggtgcccagccagggccctccagtggaccccgagccctcgaggtggaagagtgtcgctgccccccaggctatgttggcttgtcctgccaggactgtgccccgggctacactcgcactgggagcggactgtaccttggtcagtgcgagttgtgtgaatgcaacggccactccgacttgtgtcacccggagactggagcctgctcgcgatgtcagcacaacacagctggtgagttctgtgagctgtgtgcaactggttactatggagatgccacggctgggacgcctgaggattgccagccctgtgcctgcccgctgaccaacccagagaacatgttctcccgcacctgtgagagccttggagctggagggtaccgctgcaccgcctgtgaacctggctacactgggcagtactgtgagcagtgtgccccaggctatgaaggtgaccccaatgtacaaggaggccggtgccagccactgacaaaagagtccctggaggttcagatccatccatctcggagcgtggttccccaaggcggcccacactccctgaggtgccaggtcagtgggagcccaccacactacttctactggtcccgtgaagatggacggcccttgcccagcagcgctcaacagcggcatcaaggctctgagctccacttccctagcgtgcagccctccgacgccggcgtctacatctgtacctgccgaaacctgattcacacgagcaacagcagggctgagctactggtcgctgaggctcccagcaagcccatcatggtgacagtggaggagcagcggagccagagtgtgcggcccggagctgacgtcaccttcatctgtacggccaagagcaaatccccagcctacaccctggtatggacccgtctgcacaacgggaagctgccgtcccgtgctatggacttcaatggcatcctgaccattcgcaatgtgcagccaagtgacgcgggcacctacgtgtgtactggctccaacatgttcgctatggaccagggcacagccacactgcatgttcaggtctcaggcacctccactgcccctgtggcctccatacaccctccacagctcaccgtgcagccgggacaacaggctgagttccgctgtagcgccacggggaaccccacccccatgctggaatggatagggggtcctagcggccagcttcctgcgaaggctcagatccacaacggcatcctgcgcttgccagccattgaaccctcggatcagggccagtacctgtgccgtgccctcagcagcgctgggcagcatgtggccagggctatgcttcaggtgcacgggggcagtggacccagggtccaggttagccccgagaggacccaggtgcatgaaggccgcacagtgaggctgtactgcagggcagcaggggtacccagtgccagcatcacctggaggaaggagggaggcagcctgccattcagacaccaggcccatggctctcgtctacggctacaccacatgtcggtggctgactccggcgagtatgtgtgccgagccaacaacaacattgatgcccaggagacctccatcatgatctcggtctcccctagcaccaacagcccccctgcccccgccagccctgcacccatcagaatagagtcttcctcttcacgtgtggccgaaggacagaccctggatctgaactgtgtggtccctgggcacgcccatgcccaggtcacatggcacaagcgagggggtagcctgcccactcatcatcagacgcatggctcaaggctgcggctataccaggtgtcctcagccgactcgggcgaatatgtgtgcagcgttctgagcagctctggccctctggaggcttccgtcctggtctcgattacaccagctgccgctaatgtccacatccctggtgtagtcccgcccatccgcatcgagacttcctcctcccgagtggctgaggggcagaccctggatctaagctgtgtggttcctgggcaggcccatgcccaggtcacatggcacaaacgtggaggcagcctgcccgctgggcaccaggtccatggccacatgctgagactgaaccgtgtgtccccggcggactctggcgagtactcatgccaagtgacgggcagctcaggtaccctggaggcttctgtcctggtcaccatcgaggcctctgaacccagccctatccctgcccctggcctggcccagcctgtctacatagagtcctcctcctcccatttgactgaagggcagactgtagatctgaagtgcgtggtaccagggcaagcccatgcccaggtcacatggcacaaacgagggagcagcctgcctgcccgacaccagactcatggctccctgctgaggctctaccagctctcccctgctgactccggcgagtacgtgtgccaagtggctggtagctcccaccctgagcatgaggcttccttcaagctcacagtaccctccagccaaaactcttccttccgcctcagaagccccgtcatctccattgaaccacccagcagcacggtacagcagggccaagatgccagtttcaagtgccttattcacgagggagcaatgcccatcaaggttgagtggaagattcgggaccaagagctggaggacaacgtccacatcagccccaacggctccatcattaccatcgtggcacccggcccagcaaccatggagcctaccgcttgcgtggcttccaatgtctatggtatggcccagagtgtcgtcaatctcagcgtgcacgggccccctacggtgtctgtgctccccgagggccctgtgcatgtgaagatggggaaggacatcaccctggagtgtatcagttctggagaaccgcgctcttcccctcgttggacccgactcggcatccctgtcaagttggagcctcggatgtttgggctcatgaatagccacgcgatgctgaagatcgcatccgtgaaaccatcagacgcaggcacctacgtgtgccaagcccagaacgccctaggcacggcacagaagcaggtggagctgatcgtggacactggcaccgtggccccggggactccccaggtccaagttgaagaatctgagctgaccttggaggctggccacacggccactttacactgctcagccacgggcaaccccccacccaccatccactggtccaagctgcgcgccccactgccctggcagcaccggatagaaggcaacacactggtcattccccgggtggcccagcaggactcaggacagtacatctgtaacgccaccaactctgctgggcacactgaagccaccgttgtcctgcatgtggagagtcctccatatgccaccataattccagaacatacctcggcgcagccagggaacctggttcagctgcagtgcctggctcacggcacgcccccgctcacctaccagtggagccttgtgggcggcgtcctccccgagaaggcggttgtcaggaaccagctgctgcgcctggagcccacagtccccgaagactctggccgctaccgctgccaggtctccaacagggtgggctccgcggaggcctttgctcaagtcctggtccaaggctcctctagcaatctccctgacacttccatcccaggaggatccacacccactgtgcaagtcactcctcagctagagacccggaacataggggccagcgttgagttccactgtgctgtgcccaatgagcgtggcacccaccttcgctggctcaaggagggcggtcagctgcctcctggacacagtgtacaagatggagtcctcagaatccagaacttagaccagaactgccaagggacatatgtctgtcaggcccatgggccttggggacaagcccaggccactgcccagctgatcgttcaagccttgccctccgtgctcatcaacgtccgaacctctgtgcactctgtggtagtcggccactctgtggagtttgagtgcttggccctgggtgaccctaagcctcaggtgacatggagcaaagtcgggggacacctacggcctggcatcgtgcaaagcggaacgatcatcaggattgcccacgtggagctggctgatgcaggacagtaccgctgtgcagctaccaacgctgcgggcaccacccagtcccacgtgctgctgctagtacaagccttgccccagatctcaactcccccggagatccgagtgcctgccggttctgcggctgtcttcccgtgcatggcctcaggctacccgacgcctgccatcacctggagtaaggtggacggtgatctgccacctgacagtcgcctggaaaacaatatgctgatgctaccatcagttcgccccgaggatgccggcacctacgtgtgcactgccaccaaccggcagggcaaggtcaaagcctttgcctatctgcaggtgccagagcgagtgataccctacttcacccagacaccctactccttcctgccacttcccaccatcaaagatgcctacaggaagtttgagatcaagatcaccttccggccagactctgcggatgggatgctgctgtacaatgggcagaagcggagtcccaccaacctagccaacagacagccggatttcatctcctttggcctcgtgggcggaaggcctgagtttcgatttgatgccggctctggcatggccactatccgccaccccacacctctggctctaggccagttccacaccgtgaccctgttacgaagcctcactcaaggatctctgattgtgggcaatttggcccctgtcaacgggacctcccagggcaagttccaaggtttagacctgaacgaggagctgtatctgggtggctaccctgactacggtgccatccccaaggctgggctgagtagcggctttgtaggctgtgtacgtgagctgcgtatccaaggcgaggagattgtcttccatgacgtcaacctcacaacacatggcatctcccactgccctacttgccaggaccgaccctgccagaatgggggccagtgccaagattctgagagcagcagttacacgtgtgtctgccctgctggcttcacggcagccgctgtgaacattcgcaagccctgcactgccaccccgagcctgtgggccgacgccacttgtgtgaaccggccagacggtcgaggctacacctgtcgctgccacctgggccgctccggggtgaggtgtgaagaaggtgtaacggtgaccaccccatcgatgtctggtgctggttcctacctggcactaccggctctcaccaacacgcaccatgagctacgcctggatgtggagttcaagccgctggaacccaatgggatcttactgttcagtgggggcaagagcgggcctgtggaagactttgtgtccctagcaatggttggtggccacctggagttccgctatgagttagggtcaggtctggctgttctgcggagccacgagccactggccttaggacggtggcaccgagtgtctgcggaacgcctgaacaaagatggcagcctgcgggtggatggagggcgtcctgtgttacgctcttcaccaggaaagagccagggccttaacctgcataccctgctctacctgggtggtgtggagccctcggtacagctgtccccagccaccaatatgagtgctcacttccatggctgtgtgggtgaggtatctgtgaatggcaagcggttggacctcacctacagcttcttgggcagccagggtgtgggccagtgctacgacagctccccgtgcgagcgccagccctgccggaatggcgccacgtgcatgcctgcgggcgaatatgagttccagtgcctctgtcaagatggcttcaaaggagacctttgtgaacatgaggagaacccgtgccagctgcatgaaccatgtctgaatggtggcacctgccggggtgcccgatgcctctgtctgcctggcttctctggtccacgctgccaacaaggcgctggatatggggtagtggagtcagactggcaccctgaaggcagtggaggcaatgatgcccctgggcaatacggagcctacttttatgacaatggtttcctaggcctccctggtaacagtttctcaaggagcctgcctgaagtacccgagaccattgaattcgaggttcggaccagcacagccgatggcctcctgctctggcagggtgtggtgagagaggccagccgcagcaaggacttcattagccttggactacaggatggccatctagtgttcagctaccaactgggcagtggggaggcccgtcttgtctcaggagatcccatcaatgacggcgagtggcatcggataacagcgctgcgagagggccagagaggctccatccaagtagacggtgaggatctggtcactggccggtccccaggtcctaatgtggcggtcaacaccaaggacatcatctacattggtggtgccccagatgtggccacactgaccaggggcaagttctcttctgggatcacaggctgtatcaagaatctggtgttgcacacggcccggcctggagccccacctccacagcccctggacctgcagcatcgcgcccaggcaggggccaacacacggccctgcccctcataggcacccacctgcctcccacggactcctgggaagcacccagcctgacagtgtcgagtatattattattaatattattatgactttttgtaagagactgaggcaaggccacgcttcgctgctaccaccctgggctggactggagggtgggtgcgccaactcccacgcattcgtgggcagagccgaggctgatgggcaggacaaggggattggaagaggtttctcagaaggctccggaacttggagtcaggcatcgtgactggtagggctcagaactgttcccatccctttccctgcttcagcgtcaggctgggccacccacttcagcaggccgtgcgtgcggacagtcctcattgctgtgagcgccacgctcagttaccacctggtgcctcactgtcaaactgaacgagggggtgtggccatggctgagccactgttctgggagcagaaggcagctcactgcccccccccacacacacacacacaccgaccacataccatcccagcctcctccacacccacctagccagaggtcccatgtccttggcagtgtcccctcccacccagccctcctccacctgcattcccccacccctacccccataccccccccacacacacacacacagcccagctctgccctcagagctgcaagggagaccaactctttcccagaatcgctagcagagcccagcccaccacaccaggccacacccccccactcttctggaggtgaaggcccagggcgtgggggagcagggatccggagcacctgtggcttggtggaggcagctgagacctcagcttgggaaggggaacgagggatgatgataaccctgcccatctgggagcctgaggacctgactaaggggtaagcaggcccagactgtggctcttgggtcctagagggaaccccctgtggtctttctctgattttttttttcttaataaacggtgctatccccgct

SEQ ID NO: 45 - DNA, 2177 bp, Homo sapiens
caagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggacggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgctcccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgc

SEQ ID NO: 46 - DNA, 725 bp, Homo sapiens
ctaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtac

SEQ ID NO: 47 - DNA, 1847 bp, Homo sapiens
gccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaaaaaaaaaaaaaaaaaaaaaaaaaaaaaaaaaaaaaaa

SEQ ID NO: 48 - DNA, 3583 bp, Homo sapiens
acttgcgtctcgccctccggccaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcaggcctggaacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacagaccaggtgctggaaagggggcctgtgcttcagttgcatgacctgaaacgggaggcaggaggcggctatcgctgcgtggcgtctgtgcccagcatacccggcctgaaccgcacacagctggtcaagctggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagaccgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcacctgcacaccccctttcagagggccactgggttaggacctgaggacctcacttggccctgcaagccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcggcatccagaagcagctgcagtgttgctgccaccaccctcctgctcgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtacctgcggtgaggaagctgggcgctgttttcgagttcaggtgaattagcctcaatccccgtgttcacttgctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacggggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaaatcatacattgcttttttattctacatgggtaccacaggaacctgggggcctgtgaaactacaaccaaaaggcacacaaaaccgtttccagttggcagcagagatcaggggttacctctgcttctgagcaaatggctcaagctctaccagagcagacagctaccctacttttcagcagcaaaacgtcccgtatgacgcagcacgaagggcctggcaggctgttagcaggagctatgtcccttcctatcgtttccgtccactt

SEQ ID NO: 49 - DNA, 4868 bp, Homo sapiens
gccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacattttggattactacgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcagatcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgaaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggtgaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatgaaaaaaaa

SEQ ID NO: 50 - DNA, 2619 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctacagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcatgcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgctgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggctcccctgctgaaggtggggattgcccatccatctgcttacaattccctgctgtcgtcttagcaagaagtaaaatgagaaattttgttgatattcaaaaaaaa

SEQ ID NO: 51 - DNA, 7923 bp, Homo sapiens
gcgcactcgggcacgcgctcggaagtcgggggtcggcgcggagtgcaggctgctcccggggtaggtgagggaagcgcggaggcggggcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccatcacgttgctaccttacccacacttccctctgatttgcgtgaggacgtggcatcctacttacgtacgtggcataacacatcgtgtgagcccatgtatgctggggtagagcaagtagccctcccctgtctcatcgatccagcagaacctcctcagtctcagtactcttgtttctataaggaaaagttttgctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagctattatgagtgtaggacactgagccatccgtgggtcaggatgcaattatttataaaagtccccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggctggggtggggggaaagaaacctattatcatggacacactggtgctattaattatttcaaatttatatttttgtgtgaatgttttgtgttttgtttatccatgctatagaacaaggaatttatgtagatatacttagtcctatttctagaatgacactctgttcactttgctcaatttttcctcttcactggcacaagtatctgaatacctccttccctcccttctagagttctttggattgtactccaaagaattgtgccttgtgtttgcagcatctccattctctaaattaatataattgctttcctccacacccagccacgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctggcttctcccaggcctcttctactatggcaggagatgtggtgtgctgttgcaaagttttcacgtcatcgtttcctggctagttcatttcattaagtggctacatcctaacatatgcattggtcaaggttgcagcaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaattcttttccttggaattccaactgtggaccttttatatgtgccttcactttagctgtttgccttactctacagccttgctctccggggtggttaataaaatgcaacacttggcatttttatgttataagaaaaacagtattttatttataataaaatctgaatattttgtaacccttta

SEQ ID NO: 52 - DNA, 7680 bp, Homo sapiens
gaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 53 - DNA, 8027 bp, Homo sapiens
acgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcagttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 54 - DNA, 725 bp, Homo sapiens; identical to SEQ ID NO: 46

SEQ ID NO: 55 - DNA, 2161 bp, Homo sapiens
cggcccagtgatcttgaaccccaaaggccagaactggagcctcagtccagagaattctgagaaaattaaagcagagaggaggggagagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccgctggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagtt

SEQ ID NO: 56 - DNA, 2642 bp, Homo sapiens
cccacgcgtccgctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgtttcagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagcggagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacctaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattagggaaaaaaaaaaaaaaaaaaaaaaaaaaaaaaaaaaaaaaaaa

SEQ ID NO: 57 - DNA, 16382 bp, Homo sapiens
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgcacgtgccatgcgggtaaaggcatggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcaatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgcgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaacaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgaggggcctggcttctgcggacccctggcatctggcacagggggccccttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacagctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctgaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcgacgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggacatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggtgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggccgctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcggtggctgaaggatgcatcatgtgctcctaccctgctctaccgcttttctgggtcacagaggccaaatgtgagagcattgaataaatatcttaagct

SEQ ID NO: 58 - DNA, 951 bp, Homo sapiens
gtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaacttt

SEQ ID NO: 59 - DNA, 2786 bp, Homo sapiens
agcactctccagcctctcaccgcaaaattacacaccccagtacaccagcagaggaaacttataacctcgggaggcgggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcatccatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttcaaaaaaaaaaaa

SEQ ID NO: 60 - DNA, 5896 bp, Homo sapiens
ctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtatggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtatacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttatttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaattttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatctgactttgtaaattctgatttcttttcaccattcgtacataatactgaaccacttgtagatttgattttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggaaaaaaaaaaaaaaaa

SEQ ID NO: 61 - DNA, 3636 bp, Homo sapiens
ggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaaccccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccatggggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgcaacggaggggcccaaaggagaccgcggacctcagggccagcctggcctgccaggacttccgggacccatggggcctccaggg

SEQ ID NO: 62 - DNA, 2212 bp, Homo sapiens
ggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccatccaaccagggacagtgggtccccaggggaggcgaggcccccctggggcaccgggggagatcgggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaaccaaaaattggttttatttttttcttaaaaaaaaaaaaaagtctaccaaaggaatttgcatccagcagcagcacttagacctgccagccactgtcaccgagcgggtgcaagcactcggggtccctggaggcaagccctgcccacagaaagccaggagcagccctggcccccatcagccctgctacgacgcaccgcctgaaggcacagctaaccacttcgcacacacccatgtaaccactgcactttccaatgccacagacaactcacattgttcaactccttctcggggtgggacagacgagacaacagcacacaggcagccagccgtggccagaggctcgaggggctcaggggctcaggcacccgtccccacacgagggccccgtgggtggcctggccctgctttctacgccaatgttatgccagctccatgttctcccaaataccgttgatgtgaattattttaaaggcaaaactgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccaccttgtccctgagatttaacccctccactgctgggggtgagctgtactcttctgactgccccctcctgtgtaacgactacaaaataaaacttggttctgaatattttt

SEQ ID NO: 63 - DNA, 6728 bp, Homo sapiens
agcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccccgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggaccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgaccggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgccaaaggcgatgctggtccccctgggcctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccccggtcccatgggcccccctggattggctggaccccctggtgaatctggacgtgagggggctcctgctgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcccgtcggccccgtcggcgcccgtggccccgccggaccccaaggcccccgtggtgacaagggtgagacaggcgaacagggcgacagaggcataaagggtcaccgtggcttctctggcctccagggtccccctggccctcctggctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggaagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctcaagggctccaacgagatcgagatccgcgccgagggcaacagccgcttcacctacagcgtcactgtcgatggctgcacgagtcacaccggagcctggggcaagacagtgattgaatacaaaaccaccaagtcctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaaaaagaataaataaataagtttttaaaaaaggaagcttggtccacttgcttgaagacccatgcgggggtaagtccctttctgcccgttgggttatgaaaccccaatgctgccctttctgctcctttctccacaccccccttggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcatcccttgtgccgcaggctgggcgggagagactgttctgttctgttccttgtgtaactgtgttgctgaaagactacctcgttcttgtcttgatgtgtcaccggggcaactgcctgggggcggggatgggggcagggtggaagcggctccccatttttataccaaaggtgctacatctatgtgatgggtggggtggggagggaatcactggtgctatagaaattgagatgcccccccaggccagcaaatgttcctttttgttcaaagtctatttttattccttgatattttttctttctttttttttttttttgtggatggggacttgtgaatttttctaaaggtgctatttaacatgggaggagagcgtgtgcgctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggccttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 64 - DNA, 5416 bp, Homo sapiens
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgggccctcctctgcgcccccgcaggctcctcccagctgtggctgcccgggcccccagccccagccctcccattggtggaggcccttttggaggcaccctagggccagggaaacttttgccgtataaatagggcagatccgggatttgttattttagcaccacggcagcaggaggtttcggctaagttggaggtactggccacgactgcatgcccgcgcccgccatgtgatacctccgccggtgacccagggctctgcgacacaaggagtcgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtggtcttcctggtgagagaggacgtgttggtgcccctggtccagctggtgcccgtggaagtgatggaagtgtgggtcccgtaggtcctgctggtcctaatgggtctgctggccctccaggtttcccaggtgcccctggtcccaagggtgaaattggagctgttggtaacgctggtcctactggacccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctcctggtgctgccggtactactggtgccagaggacttgttggtgagcctggtccagctggctccaaaggagagagcggtaacaagggtgagcccggctccgctggtccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggccccgttggagcaagaggagagcctggcaacattggattccctggacccaaaggccccactggtgaccctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggaggcaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttcaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagcggttactactggattgaccccaaccaaggatgcactatggaagccatcaaagtatactgtgatttccctaccggcgaaacctgtatccgggcccaacctgaaaacatcccagccaagaactggtataggagctccaaggacaagaaacacgtctggctaggagaaactatcaatgctggcagccagtttgaatataatgttgaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccatgaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 65 - DNA, 5460 bp, Homo sapiens
cgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggcccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacagggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaata

SEQ ID NO: 66 - DNA, 10558 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttttccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagagatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggcggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccacagttcctggtcctcatctcgtctggaaagtctgacgatgaggtggtcgtcccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctaggggaagcggaggtgcccgtggcgctcctggagaacgaggcagaaccggtccactgggaagaaagggtgagcccggagagccaggaccaaaaggaggaatcgggaacccgggccctcgtggggagacgggagatgacgggagagacggagttggcagtgaaggacgcagaggcaaaaaaggagaaagaggatttcctggatacccaggaccaaagggtaacccaggtgaacctgggctaaatggaacaacaggacccaaaggcatcagaggccgaaggggaaattcgggacctccagggatagttggacagaaggggagacctggctacccaggaccagctggtccaaggggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgtcctgaccattgctgagagcaactgcccgacgggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaaactctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagtgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccgtccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagacggccactgttagacccccagtggcggtgaagccagcaacagcagcgaagcctgtagcagcaaagccagcagctgtaagaccccccgctgctgctgcaaaaccagtggcgaccaagcctgaggtccctaggccacaggcagccaaaccagctgccaccaagccagccaccactaagcccgtggttaagatgctccgtgaagtccaggtgtttgagataacagagaacagcgccaaactccactgggagaggcctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgttttttttttttgtgtgctggagggaggggatttaattttaattttaaaatgtttaggaaatttatacaaagaaactttttaataaagtatattgaaagtttaaaaaaaaaaaaaaaa

SEQ ID NO: 67 - DNA, 1061 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtgaaacgttactactctgttgtatatccaggctggcccatatatccacgtaacagatacacttctctctttctcattgttaattcagtaattctaatactgtctgttataattaccattttggtacagctcaagtaccctaatttagttcttttggactaatacaattcaggaaagaaaaaacccaaaaaccaacctcattcacatatggcttttttttaaccaataacaattaggtgtacttctattttaaaacatttcagaaaaaaatatatgttatagcaatactcttac

SEQ ID NO: 68 - DNA, 5676 bp, Homo sapiens
gtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccctgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggcccttccgggagaagcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaggggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagccgaattc

SEQ ID NO: 69 - DNA, 1079 bp, Homo sapiens
ctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgag

SEQ ID NO: 70 - DNA, 3667 bp, Homo sapiens
cggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacagggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttctaaaaaaa

SEQ ID NO: 71 - DNA, 3056 bp, Homo sapiens
aaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgaatgcccaggagcagctggagcggatgcgcagaaaccaggaatgtggacggcccttccctcgcccgacctccccccggcttctcaccctgggaaggacactgtccccagccagacgccagcctgacgtggagcaaaggcctgtcgtaggacactcgggagcccagaaatggctcagaagctctgggtcctggagtagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttgtaatccgcccaaaagcggcagccaatcggagcgcgaggacgtggtctggaggtaccgccgaagatctgggaccactcagggcatcagggggcgtggtctggtccccattgcgggcccgggaggggaatggtttctatggccaaagtttggttttctcaacactgtctaaatttggattaaaactttgaactttt

SEQ ID NO: 72 - DNA, 1120 bp, Homo sapiens
acttcttcgcaccagggaagccccacccaccagaacgccaagatgtccagcaagcgggccaaagccaaggccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggccatacaacttcaccatgttcctcaccatgtttggggagaagctgaacggcacggaccccgaggatgtgattcgcaacgcctttgcctgcttcgacgaggaatcctcaggtttcatccatgaggaccacctccggaagctgctcaccaccatgggtgaccgcttcacagatgaggaagtggacgagatgtaccgggaggcacccgttgataagaaaggcaacttcaactacgtggagttcacccgcatcctcaaacatggcgccaaggataaacacgactaggccatccccagccccctgacacccagcccccgccagtcacccctccccgcacacacccgtccataccagctccctgcccatgaccctcgctcagggatccccctttgagggttagggtcccagttcccagtggaagaaacaggccaggagagtgcgtgccgagctgaggcagatgttcccacagtgaccccagagccctgggctatagtctctgacccctccaaggaaagaccaccttctggggacatgggctggagggcaggacctagaggcaccaagggaaccgcattccggggctgttccccgaggaggaagggaagcctctgtgtgccccccaggaggaagaggccctgagtcctgggatcagacaccccttcacgtgtatcccacacaaatgcaagctcaccaaggtcccctctcagtccccttccctacaccctgacgccagatgccgcacacccaacgccaccagccatgggagtgtgctcaggagtcgcggggcagacgtgacatctgtccagagggggcagaatctccaatagaggactgagacaacatg

SEQ ID NO: 73 - DNA, 1085 bp, Homo sapiens
atcctgtctgtccgaacccagacacaagtcttcactccttcctgcgagccctgaggaagccttctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcccttgggcttccaggtgtggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactctggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggcgctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggcggcccccatcacctctactgtctcctccctgggctaagcaggggagaagcgggctgggggtagcctggatgtgggcgaagtccactgtcctccttggcggcaaaagcccattgaagaagaaccagcccagcctgccccctatcttgtacctggaatatttttggggttggaactctc

SEQ ID NO: 74 - DNA, 512 bp, Homo sapiens
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 75 - DNA, 1813 bp, Homo sapiens
ccgtccccggcggccccatgccccgatgccccgcgggggccatggacgaggggcccgtggacctgcgcacccggcccaaggccgccggactcccgggcgccgcgctgccgctccgcaagcgcccgctgcgcgcgccctccccggagcccgccgctccccgcggcgctgcgggccttgtcgtccccctggaccctctgcgcggcggctgcgacctgccggcggtccccgggcccccccacggcctggcccggccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggactcatgaggaggggcccccctgcccagaggggtcaacccttctggaaactgtgaagatctgacttcgcccccccccccccccatcttcgggaccaggatttgcacagaagcacatgcacctacccatacaccccctcttctgagcgtccctgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccat

SEQ ID NO: 76 - DNA, 1007 bp, Homo sapiens
atcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccggagc

SEQ ID NO: 77 - DNA, 952 bp, Homo sapiens
tgaactctggatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtca

SEQ ID NO: 78 - DNA, 1360 bp, Homo sapiens
gcccttgccttgagtcagtgcgctgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcagataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttg

SEQ ID NO: 79 - DNA, 3864 bp, Homo sapiens
ggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttc

SEQ ID NO: 80 - DNA, 1399 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 81 - DNA, 1362 bp, Homo sapiens
catttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtacttt

SEQ ID NO: 82 - DNA, 3979 bp, Homo sapiens
ggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcatgttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaagctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggcaccagtggttatagccaagaggtggtgtgctacacattaggaaatatccctcagatgccttctgcactaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaagtaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttaaaaaaaaaaaaaaaaaaaaaaaa

SEQ ID NO: 83 - DNA, 3225 bp, Homo sapiens
gcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggttcgtcgcaagcgcagggaggcccgttccaagccagctcgccctcctaccacctgtactacggcgcctcggccggctcctaccagttctccatggtgggcggggagcgctcgccgccgcgcatcctgccgccctgcaccaacgcctccaccggctccgcgctgctcaaccccagcctcccgaaccagagcgacgtggtggaggccgagggcagacacagaaactcccccaccaacatggggggggcctcctgttcgcgacaagcccgccgggatcccgggccctgggcccggacaccgtcctggggccgagggcgcccgacggacaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgagaaaaaaaaaaaaa

SEQ ID NO: 84 - DNA, 2881 bp, Homo sapiens
acagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttccgagtttccccagaagagaatatgggattttttttgacatttttgacccatttaataatgctcttgtgtttacctagtatatgtagactttgtcttatgtgtcaaaagtcctaggaaagtggttgatgtttcttatagcaattaaaaattatttttgaactga

SEQ ID NO: 85 - DNA, 1061 bp, Homo sapiens; identical to SEQ ID NO: 67

SEQ ID NO: 86 - DNA, 3000 bp, Homo sapiens
tccaattcaaaaagaaagtctctgacgttagttagtttaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagcggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttc

SEQ ID NO: 87 - DNA, 595 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaa

SEQ ID NO: 88 - DNA, 8368 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcgccccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtcaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggtacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatgggggcacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagctgcccctgccctgtgccgtgctgcgctcacctgcctccccagccagccgctgacctctcggctttcacttgggcagagggagccatttggtggcgctgcttgtcttctttggttctgggaggggtgagggatgggg

SEQ ID NO: 89 - DNA, 1110 bp, Homo sapiens
gggcgggcctcacccgcttcgagtcctcgggcttcccccacccggcccgtgggggagtatctgtcctgccgccttcgcccacgccctgcactccgggaccgtccctgcgcgctctgggcgaccatggcccgcggggctgcgctggcgctgctgctcttcggcctgctgggtgttctggtcgccgccccggatggtggtttcgatttatctgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaattt

SEQ ID NO: 90 - DNA, 8224 bp, Homo sapiens
gctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcaactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccagg

SEQ ID NO: 91 - DNA, 1110 bp, Homo sapiens
ccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagt

SEQ ID NO: 92 - DNA, 10478 bp, Homo sapiens
  Unsure 6765: Unknown base
caaacatgtcagctgttactggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggccgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccaccaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctccgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacagaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttccaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggnactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacagaaatttacttttgtgcatttgtggcaccacctactgttgaagggttataaagccattagaaaagtagaggggaagtgatttggatcaaaaggaaaaactttagaaaagattcagatgttcccttaatcataaaagagaactgaggggactacttgaaaataaaaggttgttttgtattttcatgttggttaagatactgagtaactggtattaagtgttagaggtttttagataaatattctgcttaatgattatgaagctgcactgagatttctgaaaatgctctgtagctgagcttatttaataaatgttcacttggtataggggaagctacaaaggcagccttcagtgtccttttgtttattcaaccaaaaatataaggacacaatgtagcagttatactgggaaggtgctgggggtggtggcaatggtgagcaggaaggcg

SEQ ID NO: 93 - DNA, 1192 bp, Homo sapiens
cgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgcttggtttatatttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgaaaaaaaaaaaaaaaaaaaaaaagg

SEQ ID NO: 94 - DNA, 3819 bp, Homo sapiens
ggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagccaggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcgcctagcaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 95 - DNA, 2135 bp, Homo sapiens
cggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttaaaaaaaaaaaaaaaaaaaaaaaaaaaaaaaaaaaaaaaaa

SEQ ID NO: 96 - DNA, 3703 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttaaa

SEQ ID NO: 97 - protein, 671 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 98 - protein, 236 aa, Homo sapiens
MPGAAAAAAAAAAAMLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 99 - protein, 208 aa, Homo sapiens
MGSCSGRCALVVLCAFQLVAALERQVFDFLGYQWAPILANFVHIIIVILGLFGTIQYRLRYVMVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 100 - protein, 723 aa, Homo sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 101 - protein, 2314 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 102 - protein, 1376 aa, Homo sapiens
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDVSSLSFYVSLLFWQNLFQLLSYLILRMNDEPVVEWGEQEDY

SEQ ID NO: 103 - protein, 434 aa, Homo sapiens
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEGRLV

SEQ ID NO: 104 - protein, 731 aa, Homo sapiens
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTAASSTTFPKANKRKNQNIGYKLGHRRAPFEKRKRLSDYALIFGMFGIVVMVIETELSWGLYSKDSMFSLALKCLISLSTIILLGLIIAYHTREAQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 105 - protein, 317 aa, Homo sapiens [sequence omitted]

SEQ ID NO: 106 - protein, 520 aa, Homo sapiens
MGSRARGGAAGPPLKETCCGSRSGTRASAAAAAAAGARVGATARRPRVPERPQGSPGRRPRCASPVRAPPRAAPMLDMSEARSQPPCSPSGTASSMSHVEDSDSDAPPSPAGSEGLGRAGVAVGGARGDPAEAADERFPACIRDAVSQVLKGYDWSLVPMPVRGGGGGALKAKPHVKRPMNAFMVWAQAARRKLADQYPHLHNAELSKTLGKLWRLLSESEKRPFVEEAERLRVQHKKDHPDYKYQPRRRKSAKAGHSDSDSGAELGPHPGGGAVYKAEAGLGDGHHHGDHTGQTHGPPTPPTTPKTELQQAGAKPELKLEGRRPVDSGRQNIDFSNVDISELSSEVMGTMDAFDVHEFDQYLPLGGPAPPEPGQAYGGAYFHAGASPVWAHKSAPSASASPTETGPPRPHIKTEQPSPGHYGDQPRGSPDYGSCSGQSSATPAAPAGPFAGSQGDYGDLQASSYYGAYPGYAPGLYQYPCFHSPRRPYASPLLNGLALPPAHSPTSHWDQPVYTTLTRP

SEQ ID NO: 107 - protein, 271 aa, Homo sapiens
MYYAVSQARVNAVPGTMLRPQRPGDLQLGASLYELVGYRQPPSSSSSSTSSTSSTSSSSTTAPLLPKAAREKPEAPAEPPGPGPGSGAHPGGSARPDAKEEQQQQLRRKINSRERKRMQDLNLAMDALREVILPYSAAHCQGAPGRKLSKIATLLLARNYILLLGSSLQELRRALGEGAGPAAPRLLLAGLPLLAAAPGSVLLAPGAVGPPDALRPAKYLSLALDEPPCGQFALPGGGAGGPGLCTCAVCKFPHLVPASLGLAAVQAQFSK

SEQ ID NO: 108 - protein, 357 aa, Homo sapiens
LRLFGASSSNRIQIFGSEGRRTLRKLRRLSSPGAMDSDASLVSSRPSSPEPDDLFLPARSKGSSGSAFTGGTVSSSTPSDCPPELSAELRGAMGSAGAHPGDKLGGSGFKSSSSSTSSSTSSAAASSTKKDKKQMTEPELQQLRLKINSRERKRMHDLNIAMDGLREVMPYAHGPSVRKLSKIATLLLARNYILMLTNSLEEMKRLVSEIYGGHHAGFHPSACGGLAHSAPLPAATAHPAAAAHAAHHPAVHHPILPPAAAAAAAAAAAAAVSSASLPGSGLPSVGSIRPPHGLLKSPSAAAAAPLGGGGGGSGASGGFQHWGGMPCPCSMCQVPPPHHHVSAMGAGSLPRLTSDAK

SEQ ID NO: 109 - protein, 2303 aa, Homo sapiens
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETQFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 110 - protein, 572 aa, Homo sapiens
MSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 111 - protein, 156 aa, Homo sapiens
MFLTEDLITFNLRNFLLFQLWESSFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 112 - protein, 620 aa, Homo sapiens
MSRPGHGGLMPVNGLGFPPQNVARVVVWECLNEHSRWRPYTATVCHHIENVLKEDARGSVVLGQVDAQLVPYIIDLQSMHQFRQDTGTMRPVRRNFYDPSSAPGKGIVWEWENDGGAWTAYDMDICITIQNAYEKQHPWLDLSSLGFCYLIYFNSMSQMNRQTRRRRRLRRRLDLAYPLTVGSIPKSQSWPVGASSGQPCSCQQCLLVNSTRAVSNVILASQRRKVPPAPPLPPPPPPGGPPGALAVRPSATFTGAALWAAPAAGPAEPAPPPGAPPRSPGAPGGARTPGQNNLNRPGPQRTTSVSARASIPPGVPALPVKNLNGTGPVHPALAGMTGILLCAAGLPVCLTRAPKPILHPPPVSKSDVKPVPGVPGVCRKTKKKHLKKSKNPEDVVRRYMQKVKNPPDEDCTICMERLVTASGYEGVLRHKGVRPELVGRLGRCGHMYHLLCLVAMYSNGNKDGSLQCPTCKAIYGEKTGTQPPGKMEFHLIPHSLPGFPDTQTIRIVYDIPTGIQGPEHPNPGKKFTARGFPRHCYLPNNEKGRKVLRLLITAWERRLIFTIGTSNTTGESDTVVWNEIHHKTEFGSNLTGHGYPDASYLDNVLAELTAQGVSEAAGKA

SEQ ID NO: 113 - protein, 848 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 114 - protein, 996 aa, Homo sapiens
MRPVALLLLPSLLALLAHGLSLEAPTVGKGQAPGIEETDGELTAAPTPEQPERGVHFVTTAPTLKLLNHHPLLEEFLHEGLEKGDEELRPALSFQPDPPAPFTPSPLPRLANQDSRPVFTSPTPAMAAVPTQPQSKEGPWSPDPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVKNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIGECPGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGSTTVAAWMVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 115 - protein, 222 aa, Homo sapiens
MAPPAAPGRDRVGREDEDGWETRGDRKARKPLVEKKRRARINESLQELRLLLAGAEAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 116 - protein, 238 aa, Homo sapiens
MESSAKMESGGAGQQPQPQPQQPFLPPAACFFATAAAAAAAAAAAAAQSAQQQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 117 - protein, 360 aa, Homo sapiens
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSANGTSSSQLSTPKSKQSPISTPTSPGSLRKHKDLYLPLSLDDSDSLGDSM

SEQ ID NO: 118 - protein, 361 aa, Homo sapiens
MGGAVSAGEDNEELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 119 - protein, 823 aa, Homo sapiens
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 120 - protein, 205 aa, Homo sapiens
MLRALSRLGAGTPCRPRAPLVLPARGRKTRHDPLAKSKIERVNMPPAVDPAEFFVLMERYQHYRQTVRALRMEFVSEVQRKVHEARAGVLAERKALKDAAEHRELMAWNQAENRRLHELRIARLRQEEREQEQRQALEQARKAEEVQAWAQRKEREVLQLQEEVKNFITRENLEARVEAALDSRKNYNWAITREGLVVRPQRRDS

SEQ ID NO: 121 - protein, 456 aa, Homo sapiens
MPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVVPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 122 - protein, 667 aa, Homo sapiens
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 123 - protein, 808 aa, Homo sapiens
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHASHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 124 - protein, 160 aa, Homo sapiens [sequence omitted]

SEQ ID NO: 125 - protein, 424 aa, Homo sapiens
SQQLWLGSPDEVWLYLVCEHTHIFTAIIWDSRTRFGSTDFSFHPSIAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 126 - protein, 809 aa, Homo sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 127 - protein, 338 aa, Homo sapiens
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIKGRVFSKLKQLKKLHINHNNLTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 128 - protein, 163 aa, Homo sapiens
MSLLLLVVSALHILILILLFVATLDKSWWTLPGKESLNLWYDCTWNNDTKTWACSNVSENGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 129 - protein, 207 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 130 - protein, 383 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRTLGQQVPYATKGNQWVGYDDQESVKSKVQYLKDRQLAGAMVWALDLDDFQGSFCGQDLRFPLTNAIKDALAAT

SEQ ID NO: 131 - protein, 361 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTYNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 132 - protein, 2201 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGLDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDLTGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAQALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 133 - protein, 491 aa, Homo sapiens [sequence omitted]

SEQ ID NO: 134 - protein, 683 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 135 - protein, 317 aa, Homo sapiens
MKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGGDNGEEGEEESVTGANAEGTTETGGQGKGTSKTTTSPNGGFEPTTPPQVYRTTSPPFGKTTTVEYEGEYEYTGVNEYDNGYEIYESENGEPRGDNYRAYEDEYSYFKGQGYDGYDGQNYYHHQ

SEQ ID NO: 136 - protein, 574 aa, Homo sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMALARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 137 - protein, 774 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 138 - protein, 178 aa, Homo sapiens [sequence omitted]

SEQ ID NO: 139 - protein, 3707 aa, Homo sapiens
MGQRAVGSLLLGLLLHARLLAVTHGLRAYDGLSLPEDTETVTASRYGWTYSYLSDDEDLLADDASGDGLGSGDVGSGDFQMVYFRALVNFTRSIEYSPQLEDASAKEFREVSEAVVEKLEPEYRKIPGDQIVSVVFIKELDGWVFVELDVGSEGNADGSQIQEVLHTVVSSGSIGPYVTSPWGFKFRRLGTVPQFPRVCTETEFACHSYNECVALEYRCDRRPDCRDMSDELNCEEPVPELSSSTPAVGKVSPLPLWPEAATTPPPPVTHGPQFLLPSVPGPSACGPQEASCHSGHCIPRDYLCDGQEDCRDGSDELGCASPPPCEPNEFACENGHCALKLWRCDGDFDCEDRTDEANCSVKQPGEVCGPTHFQCVSTNRCIPASFHCDEESDCPDRSDEFGCMPPQVVTPPQQSIQASRGQTVTFTCVATGVPTPIINWRLNWGHIPAHPRVTMTSEGGRGTLIIRDVKEADQGAYTCEAMNSRGMVFGIPDGVLELVPQRGPCPDGHFYLEDSASCLPCFCFGVTNVCQSSLRFRDQIRLSFDQPNDFKGVNVTMPSQPGVPPLSSTQLQIDPALQEFQLVDLSRRFLVHDAFWALPKQFLGNKVDSYGGFLRYKVRYELARGMLEPVQKPDVILVGAGYRLHSRGHTPTHPGTLNQRQVQLSEEHWVHESGRPVQRAEMLQALASLEAVLLQTVYNTKMASVGLSDIVMDTTVTHTTIHGRAHSVEECRCPIGYSGLSCESCDAHFTRVPGGPYLGTCSGCNCNGHASSCDPVYGHCLNCQHNTEGPQCDKCKPGFFGDATKATATACRPCPCPYIDASRRFSDTCFLDTDGQATCDACAPGYTGRRCESCAPGYEGNPIQPGGKCRPTTQEIVRCDERGSLGTSGETCRCKNNVVGRLCNECSDGSFHLSKQNPDGCLKCFCMGVSRQCSSSSWSRAQVLGASEQPSQFSLSNAAGTHTTSEGVSSPAPGELSFSSFHNLLSEPYFWSLPASFRGDKVTSYGGELRFTVMQRPRPSSAPLHRQPLVVLQGNNIVLEHHASRDPSPGQPSNFIVPFQEQAWQRPDGQPATREHLLMALAGIDALLIQASYTQQPAESRLSGISMDVAVPENTGQDSAREVEQCTCPPGYRGPSCQDCDTGYTRVPSGLYLGTCERCNCHGHSETCEPETGACQSCQHHTEGASCEQCQPGYYGDAQRGTPQDCQPCPCYGAPAAGQAAHTCFLDTDGHPTCDSCSPGHSGRHCERCAPGYYGNPSQGQPCHRDGQVPEVLGCGCDPHGSISSQCDAAGQCQCKAQVEGRSCSHCRPHHFHLSASNPEGCLPCFCMGVTQQCASSSYSRQLISTHFAPGDFQGFALVNPQRNSQLTGGFTVEPVHDGARLSFSNFAHLGQESFYWQLPEIYQGDKVAAYGGKLRYTLSYTAGPQGSPLLDPDIQITGNNIMLVASQPALQGPERRSYEIIFREEFWRRPDGQPATREHLLMALADLDELLVRATFSSVPRAASISAVSLEGAQPGPSSGPRALEVEECRCPPGYVGLSCQDCAPGYTRTGSGLYLGQCELCECNGHSDLCHPETGACSRCQHNTAGEFCELCATGYYGDATAGTPEDCQPCACPLTNPENMFSRTCESLGAGGYRCTACEPGYTGQYCEQCAPGYEGDPNVQGGRCQPLTKESLEVQIHPSRSVVPQGGPHSLRCQVSGSPPHYFYWSREDGRPLPSSAQQRHQGSELHFPSVQPSDAGVYICTCRNLIHTSNSRAELLVAEAPSKPIMVTVEEQRSQSVRPGADVTFICTAKSKSPAYTLVWTRLHNGKLPSRAMDFNGILTIRNVQPSDAGTYVCTGSNMFAMDQGTATLHVQVSGTSTAPVASIHPPQLTVQPGQQAEFRCSATGNPTPMLEWIGGPSGQLPAKAQIHNGILRLPAIEPSDQGQYLCRALSSAGQHVARAMLQVHGGSGPRVQVSPERTQVHEGRTVRLYCRAAGVPSASITWRKEGGSLPFRHQAHGSRLRLHHMSVADSGEYVCRANNNIDAQETSIMISVSPSTNSPPAPASPAPIRIESSSSRVAEGQTLDLNCVVPGHAHAQVTWHKRGGSLPTHHQTHGSRLRLYQVSSADSGEYVCSVLSSSGPLEASVLVSITPAAANVHIPGVVPPIRIETSSSRVAEGQTLDLSCVVPGQAHAQVTWHKRGGSLPAGHQVHGHMLRLNRVSPADSGEYSCQVTGSSGTLEASVLVTIEASEPSPIPAPGLAQPVYIESSSSHLTEGQTVDLKCVVPGQAHAQVTWHKRGSSLPARHQTHGSLLRLYQLSPADSGEYVCQVAGSSHPEHEASFKLTVPSSQNSSFRLRSPVISIEPPSSTVQQGQDASFKCLIHEGAMPIKVEWKIRDQELEDNVHISPNGSIITIVAPGPATMEPTACVASNVYGMAQSVVNLSVHGPPTVSVLPEGPVHVKMGKDITLECISSGEPRSSPRWTRLGIPVKLEPRMFGLMNSHAMLKIASVKPSDAGTYVCQAQNALGTAQKQVELIVDTGTVAPGTPQVQVEESELTLEAGHTATLHCSATGNPPPTIHWSKLRAPLPWQHRIEGNTLVIPRVAQQDSGQYICNATNSAGHTEATVVLHVESPPYATIIPEHTSAQPGNLVQLQCLAHGTPPLTYQWSLVGGVLPEKAVVRNQLLRLEPTVPEDSGRYRCQVSNRVGSAEAFAQVLVQGSSSNLPDTSIPGGSTPTVQVTPQLETRNIGASVEFHCAVPNERGTHLRWLKEGGQLPPGHSVQDGVLRIQNLDQNCQGTYVCQAHGPWGQAQATAQLIVQALPSVLINVRTSVHSVVVGHSVEFECLALGDPKPQVTWSKVGGHLRPGIVQSGTIIRIAHVELADAGQYRCAATNAAGTTQSHVLLLVQALPQISTPPEIRVPAGSAAVFPCMASGYPTPAITWSKVDGDLPPDSRLENNMLMLPSVRPEDAGTYVCTATNRQGKVKAFAYLQVPERVIPYFTQTPYSFLPLPTIKDAYRKFEIKITFRPDSADGMLLYNGQKRSPTNLANRQPDFISFGLVGGRPEFRFDAGSGMATIRHPTPLALGQFHTVTLLRSLTQGSLIVGNLAPVNGTSQGKFQGLDLNEELYLGGYPDYGAIPKAGLSSGFVGCVRELRIQGEEIVFHDVNLTTHGISHCPTCQDRPCQNGGQCQDSESSSYTCVCPAGFTAAAVNIRKPCTATPSLWADATCVNRPDGRGYTCRCHLGRSGVRCEEGVTVTTPSMSGAGSYLALPALTNTHHELRLDVEFKPLEPNGILLFSGGKSGPVEDFVSLAMVGGHLEFRYELGSGLAVLRSHEPLALGRWHRVSAERLNKDGSLRVDGGRPVLRSSPGKSQGLNLHTLLYLGGVEPSVQLSPATNMSAHFHGCVGEVSVNGKRLDLTYSFLGSQGVGQCYDSSPCERQPCRNGATCMPAGEYEFQCLCQDGFKGDLCEHEENPCQLHEPCLNGGTCRGARCLCLPGFSGPRCQQGAGYGVVESDWHPEGSGGNDAPGQYGAYFYDNGFLGLPGNSFSRSLPEVPETIEFEVRTSTADGLLLWQGVVREASRSKDFISLGLQDGHLVFSYQLGSGEARLVSGDPINDGEWHRITALREGQRGSIQVDGEDLVTGRSPGPNVAVNTKDIIYIGGAPDVATLTRGKFSSGITGCIKNLVLHTARPGAPPPQPLDLQHRAQAGANTRPCPS

SEQ ID NO: 140 - protein, 402 aa, Homo sapiens [sequence omitted]

SEQ ID NO: 141 - protein, 99 aa, Homo sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 142 - protein, 331 aa, Homo sapiens [sequence omitted]

SEQ ID NO: 143 - protein, 646 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQAWNLDTMISLLSEPQELLVNYVSDVRVSPAAPERQEGSSLTLTCEAESSQDLEFQWLREETDQVLERGPVLQLHDLKREAGGGYRCVASVPSIPGLNRTQLVKLAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKTELVVEVKSDKLPEEMGLLQGSSGDKRAPGDQGEKYIDLRH

SEQ ID NO: 144 - protein, 1375 aa, Homo sapiens
MEGDRVAGRPVLSSLPVLLLLQLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDILDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASDHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVPANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPVNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 145 - protein, 711 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPTGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTACKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 146 - protein, 1609 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNPYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 147 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 148 - protein, 99 aa, Homo sapiens; identical to SEQ ID NO: 141

SEQ ID NO: 149 - protein, 455 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 150 - protein, 496 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 151 - protein, 5405 aa, Homo sapiens
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPGGCGSECHEGCVCDEGFALSGESCLPLASCGCVHQGTYHPPGQTFYPGPGCDSLCHCQEGGLVSCESSSCGPHEACQPSGGSLGCVAVGSSTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQQMCGLCGNYNGDPKDDFQKPNGSQAGNANEFGNSWEEVVPDSPCLPPTPCPPGSEDCIPSHKCPPELEKKYQKEEFCGLLSSPTGPLSSCHKLVDPQGPLKDCIFDLCLGGGNLSILCSNIHAYVSACQAAGGHVEPWRTETFCPMECPPNSHYELCADTCSLGCSALSAPPQCQDGCAEGCQCDSGFLYNGQACVPIQQCGCYHNGVYYEPEQTVLIDNCRQQCTCHAGKGMVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFNFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNGQACVPIQQCGCYHNGAYYEPEQTVLIDNCRQQCTCHAGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDHDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNGQACVPIQQCGCYHNGVYYEPEQTVLIDNCRQQCTCHVGKVVVCQEHSCKPGQVCQPSGGILSCVNKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLASGTGGPFTTCHAHVPPESFFKGCVLDVCMGGGDHDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHSCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVALPFQLDSLLHAHLSGADVVVTTTSGLSLAFDGDSFVRLRVPAAYAASLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLGEWRRPDFCPLQCPAHSHYELCGDSCPVSCPSLSAPEGCESACREGCVCDAGFVLSGDTCVPVGQCGCLHDGRYYPLGEVFYPGPECERRCECGPGGHVTCQEGAACGPHEECRLEDGVQACHATGCGRCLANGGIHYITLDGRVYDLHGSCSYVLAQVCHPKPGDEDFSIVLEKNAAGHLQRLLVTVAGQVVSLAQGQQVTVDGEAVALPVAVGRVRVTAEGRNMVLQTTKGLRLLFDGDAHLLMSIPSPFRGRLCGLCGNFNGNWSDDFVLPNGSAASSVETFGAAWRVPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 152 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 153 - protein, 157 aa, Homo sapiens
MLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCWLCILVGVSIYTSHYANRDGTQYHHGYSYILGWICFCFSFIIGVLYLVLRKK

SEQ ID NO: 154 - protein, 1218 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 155 - protein, 1212 aa, Homo sapiens
GQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPWGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPG

SEQ ID NO: 156 - protein, 459 aa, Homo sapiens
GERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAIQPGTVGPQGRRGPPGAPGEIGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 157 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPAAEGSPGRDGSPGAKGDRGETGPAGPPGAPGAPGAPGPVGPAGKSGDRGETGPAGPAGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLKGSNEIEIRAEGNSRFTYSVTVDGCTSHTGAWGKTVIEYKTTKSSRLPIIDVAPLDVGAPDQEFGFDVGPVCFL

SEQ ID NO: 158 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPNGSAGPPGFPGAPGPKGEIGAVGNAGPTGPAGPRGEVGLPGLSGPVGPPGNPGANGLTGAKGAAGLPGVAGAPGLPGPRGIPGPPGAAGTTGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPVGARGEPGNIGFPGPKGPTGDPGKNGDKGHAGLAGARGAPGPDGNNGAQGPPGPQGVQGGKGEQGPAGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAHGAVGAPGPAGATGDRGEAGAAGPAGPAGPRGSPGERGEVGPAGPNGFAGPAGAAGQPGAKGERGGKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGFKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMEAIKVYCDFPTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADHEFFVDIGPVCFK

SEQ ID NO: 159 - protein, 1466 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 160 - protein, 3176 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVVVPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGARGAPGERGRTGPLGRKGEPGEPGPKGGIGNPGPRGETGDDGRDGVGSEGRRGKKGERGFPGYPGPKGNPGEPGLNGTTGPKGIRGRRGNSGPPGIVGQKGRPGYPGPAGPRGNRGDSIDQCALIQSIKDKCPCCYGPLECPVFPTELAFALDTSEGVNQDTFGRMRDVVLSIVNVLTIAESNCPTGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 161 - protein, 266 aa, Homo sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNRYTSLFLIVNSVILILSVIITILVQLKYPNLVLLD

SEQ ID NO: 162 - protein, 1838 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGKPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGPSGRSGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPRGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 163 - protein, 152 aa, Homo sapiens
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVLGLIATCLFGYDAYVTFPVRQPRHTAAPTDPADGPV

SEQ ID NO: 164 - protein, 1016 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 165 - protein, 779 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKAPVARPRMNAQEQLERMRRNQECGRPFPRPTSPRLLTLGRTLSPARRQPDVEQRPVVGHSGAQKWLRSSGSWSSPRNTTPYLPTSEGHRERVLSLSQALATEASQWHRMMTGGNLDSQGDPLPGVPLPPSDPTRQETPPPRSPPVANSGSTGFSRRGSGRGGGPTPWGPAWDAGIAPPVLPQDEGAWPLRVTLLQSSL

SEQ ID NO: 166 - protein, 172 aa, Homo sapiens
MSSKRAKAKATKKRPQRATSNVFAMFDQSQIQEFKEAFNMIDQNRDGFIDKEDLHDMLASLGKNPTDEYLEGMMSEAPGPYNFTMFLTMFGEKLNGTDPEDVIRNAFACFDEESSGFIHEDHLRKLLTTMGDRFTDEEVDEMYREAPVDKKGNFNYVEFTRILKHGAKDKHD

SEQ ID NO: 167 - protein, 201 aa, Homo sapiens
MANKGPSYGMSREVQSKIEKKYDEELEERLVEWIIVQCGPDVGRPDRGPLGFQVWLKNGVILSKLVNSLYPDGSKPVKVPENPPSMVFKQMEQVAQFLKAAEDSGVIKTDMFQTVDLFEGKDMAAVQRTLMALGSLAVTKNDGHYRGDPNWFMKKAQEHKREFTESQLQEGKHVIGLQMGSNRGASQAGMTGYGRPRQIIS

SEQ ID NO: 168 - protein, 101 aa, Homo sapiens
MACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 169 - protein, 446 aa, Homo sapiens
MDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 170 - protein, 326 aa, Homo sapiens
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 171 - protein, 264 aa, Homo sapiens
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYVCDLEGNRVKGPEKEEKLRQAVKQVLKCDVTQSQPLGAVPLPPADCVLSTLCLDAACPDLPTYCRALRNLGSLLKPGGFLVIMDALKSSYYMIGEQKFSSLPLGREAVEAAVKEAGYTIEWFEVISQSYSSTMANNEGLFSLVARKLSRPL

SEQ ID NO: 172 - protein, 199 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 173 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 174 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 175 - protein, 339 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 176 - protein, 1204 aa, Homo sapiens
MYVTMMMTDQIPLELPPLLNGEVAMMPHLVNGDAAQHVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSSYITREDQYSKPPHKKLKDRQIDRQNRLNSPPSSIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTSGYSQEVVCYTLGNIPQMPSALRLVRAGITWVTLQWSKPEGCSPEEVITYTLEIQEDENDNLFHPKYTGEDLTCTVKNLKRSTQYKFRLTASNTEGKSCPSEVLVCTTSPDRPGPPTRPLVKGPVTSHGFSVKWDPPKDNGGSEILKYLLEITDGNSEANQWEVAYSGSATEYTFTHLKPGTLYKLRACCISTGGHSQCSESLPVRTLSIAPGQCRPPRVLGRPKHKEVHLEWDVPASESGCEVSEYSVEMTEPEDVASEVYHGPELECTVGNLLPGTVYRFRVRALNDGGYGPYSDVSEITTAAGPPGQCKAPCISCTPDGCVLVGWESPDSSGADISEYRLEWGEDEESLELIYHGTDTRFEIRDLLPAAQYCCRLQAFNQAGAGPYSELVLCQTPASAPDPVSTLCVLEEEPLDAYPDSPSACLVLNWEEPCNNGSEILAYTIDLGDTSITVGNTTMHVMKDLLPETTYRIRIQAINEIGAGPFSQFIKAKTRPLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEVNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 177 - protein, 472 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGRHRNSPTNMGGASCSRQARRDPGPWARTPSWGRGRPTDRISL

SEQ ID NO: 178 - protein, 592 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAAQLEKKRDDFCKQNQEASSDRCSGLLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 179 - protein, 266 aa, Homo sapiens; identical to SEQ ID NO: 161

SEQ ID NO: 180 - protein, 957 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGRVKSIAATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 181 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 182 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGHEHIPGSPYRVVVP

SEQ ID NO: 183 - protein, 185 aa, Homo sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 184 - protein, 2409 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 185 - protein, 245 aa, Homo sapiens
  Unsure 233: Unknown amino acid
MASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCXSRAITNNQYEIV

SEQ ID NO: 186 - protein, 2201 aa, Homo sapiens [sequence omitted]

SEQ ID NO: 187 - protein, 228 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 188 - protein, 303 aa, Homo sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 189 - protein, 303 aa, Homo sapiens; identical to SEQ ID NO: 188

SEQ ID NO: 190 - protein, 1116 aa, Homo sapiens
MVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

What is claimed is:

1. A method of determining the presence of a type A glioma tumor in a human, said method comprising:

(a) obtaining a test tissue sample from said human, wherein said test tissue sample is suspected of being a glial cell-derived tumor; and (b) detecting at least a 5 fold increase in the amount of at least 3 different type A antigens in said test sample as compared to normal adult human brain, wherein each of said at least 3 different type A antigens is encoded by a different DNA sequence selected from SEQ ID NOs:1, 2, 3, 4, 5, 8, 9, 11, 12, 18, 20, 21, 23, 26 and 28, and wherein one of the at least 3 different type A antigens is encoded by a DNA sequence selected from SEQ ID NO:8, SEQ ID NO:9, and SEQ ID NO:1, and wherein said detecting is indicative of said test tissue sample being a type A glioma tumor.

2. The method according to claim 1, wherein said increase is detected at the mRNA level.

3. The method according to claim 1, wherein said increase is detected at the protein level.

4. The method of claim 1, wherein the one of the at least 3 different type A antigens is encoded by the DNA sequence of SEQ ID NO:9.

5. The method of claim 1, wherein the one of the at least 3 different type A antigens is encoded by the DNA sequence of SEQ ID NO:1.

6. The method of claim 1, wherein the one of the at least 3 different type A antigens is encoded by the DNA sequence of SEQ ID NO:8.

7. The method of claim 4, wherein another of the at least 3 different type A antigens is encoded by the DNA sequence of SEQ ID NO:1.

8. The method of claim 6, wherein another of the at least 3 different type A antigens is encoded by the DNA sequence of SEQ ID NO:1.

9. The method of claim 6, wherein another of the at least 3 different type A antigens is encoded by the DNA sequence of SEQ ID NO:9.

10. The method of claim 9, wherein another of the at least 3 different type A antigens is encoded by the DNA sequence of SEQ ID NO:1.

* * * * *